United States Patent 11,718,660 (RECOMBINANT POLYCLONAL PROTEINS TARGETING ZIKA AND METHODS OF USE THEREOF) - sequence listing, part 2

SEQ ID NO: 21729 - protein, 9 aa, Homo sapiens
  Light chain CDR3 for antibody 10865 (IGKV1D-13)
QHFNNYMYT

SEQ ID NO: 21730 - protein, 9 aa, Homo sapiens
  Heavy chain CDR3 for antibody 10865 (IGHV4-59)
AREGGSGSL

SEQ ID NO: 21731 - protein, 9 aa, Homo sapiens
  Light chain CDR3 for antibody 10866 (IGKV1-9)
QQLISYPLT

SEQ ID NO: 21732 - protein, 15 aa, Homo sapiens
  Heavy chain CDR3 for antibody 10866 (IGHV3-33)
ARGYYYGSGSFPFDY

SEQ ID NO: 21733 - protein, 9 aa, Homo sapiens
  Light chain CDR3 for antibody 10867 (IGKV1-17)
LQHNSYPPT

SEQ ID NO: 21734 - protein, 8 aa, Homo sapiens
  Heavy chain CDR3 for antibody 10867 (IGHV4-34)
ARGARFDP

SEQ ID NO: 21735 - protein, 9 aa, Homo sapiens
  Light chain CDR3 for antibody 10868 (IGKV1-17)
LQHNSYPLT

SEQ ID NO: 21736 - protein, 12 aa, Homo sapiens
  Heavy chain CDR3 for antibody 10868 (IGHV3-33)
ARKGYDMHAFDI

SEQ ID NO: 21737 - protein, 9 aa, Homo sapiens
  Light chain CDR3 for antibody 10869 (IGKV3-11)
QQRSNWPYT

SEQ ID NO: 21738 - protein, 13 aa, Homo sapiens
  Heavy chain CDR3 for antibody 10869 (IGHV3-11)
ARDEGYSGYNLDN

SEQ ID NO: 21739 - protein, 9 aa, Homo sapiens
  Light chain CDR3 for antibody 10870 (IGKV2D-28)
MQALQTPPT

SEQ ID NO: 21740 - protein, 13 aa, Homo sapiens
  Heavy chain CDR3 for antibody 10870 (IGHV6-1)
ARHVLLWFGEFDP

SEQ ID NO: 21741 - protein, 9 aa, Homo sapiens
  Light chain CDR3 for antibody 10871 (IGKV1-39)
QQSYSTPLT

SEQ ID NO: 21742 - protein, 11 aa, Homo sapiens
  Heavy chain CDR3 for antibody 10871 (IGHV3-23)
AKAYSGSYGDY

SEQ ID NO: 21743 - protein, 9 aa, Homo sapiens
  Light chain CDR3 for antibody 10872 (IGKV1-6)
LQDHNYPYT

SEQ ID NO: 21744 - protein, 12 aa, Homo sapiens
  Heavy chain CDR3 for antibody 10872 (IGHV3-h)
ARDIGGRSSFDY

SEQ ID NO: 21745 - protein, 9 aa, Homo sapiens
  Light chain CDR3 for antibody 10873 (IGKV6-21)
HQSSSLPYT

SEQ ID NO: 21746 - protein, 9 aa, Homo sapiens
  Heavy chain CDR3 for antibody 10873 (IGHV4-59)
ARGGVHFDS

SEQ ID NO: 21747 - protein, 9 aa, Homo sapiens
  Light chain CDR3 for antibody 10874 (IGKV1-9)
QQSYSTPFT

SEQ ID NO: 21748 - protein, 13 aa, Homo sapiens
  Heavy chain CDR3 for antibody 10874 (IGHV3-33)
ARDGSMVRGVIDY

SEQ ID NO: 21749 - protein, 9 aa, Homo sapiens
  Light chain CDR3 for antibody 10875 (IGKV1-9)
QQYNTYSRT

SEQ ID NO: 21750 - protein, 18 aa, Homo sapiens
  Heavy chain CDR3 for antibody 10875 (IGHV3-33)
ARDGRISLVRGIIDAFDI

SEQ ID NO: 21751 - protein, 9 aa, Homo sapiens
  Light chain CDR3 for antibody 10876 (IGKV1D-13)
QQFNNYPST

SEQ ID NO: 21752 - protein, 12 aa, Homo sapiens
  Heavy chain CDR3 for antibody 10876 (IGHV3-21)
AREGFGESSFDY

SEQ ID NO: 21753 - protein, 11 aa, Homo sapiens
  Light chain CDR3 for antibody 10877 (IGKV3-11)
QQRSNWPPTWT

SEQ ID NO: 21754 - protein, 18 aa, Homo sapiens
  Heavy chain CDR3 for antibody 10877 (IGHV3-33)
ARDRYYDILTGYYMGFDY

SEQ ID NO: 21755 - protein, 10 aa, Homo sapiens
  Light chain CDR3 for antibody 10878 (IGKV3-11)
QQRSNWPILT

SEQ ID NO: 21756 - protein, 18 aa, Homo sapiens
  Heavy chain CDR3 for antibody 10878 (IGHV3-33)
ARDEYYGSGIYYNYGMDV

SEQ ID NO: 21757 - protein, 9 aa, Homo sapiens
  Light chain CDR3 for antibody 10879 (IGKV1-9)
QQLNGYPFT

SEQ ID NO: 21758 - protein, 11 aa, Homo sapiens
  Heavy chain CDR3 for antibody 10879 (IGHV3-33)
ARDRVLTPFDY

SEQ ID NO: 21759 - protein, 8 aa, Homo sapiens
  Light chain CDR3 for antibody 10880 (IGKV1-5)
QQYNSYYT

SEQ ID NO: 21760 - protein, 12 aa, Homo sapiens
  Heavy chain CDR3 for antibody 10880 (IGHV3-33)
ARAGMGAPYFEY

SEQ ID NO: 21761 - protein, 9 aa, Homo sapiens
  Light chain CDR3 for antibody 10881 (IGKV5-2)
LQHDNFPLT

SEQ ID NO: 21762 - protein, 16 aa, Homo sapiens
  Heavy chain CDR3 for antibody 10881 (IGHV1-18)
TRGTFYYGSGSSFFDY

SEQ ID NO: 21763 - protein, 9 aa, Homo sapiens
  Light chain CDR3 for antibody 10882 (IGKV3-11)
QQRSNRPLT

SEQ ID NO: 21764 - protein, 13 aa, Homo sapiens
  Heavy chain CDR3 for antibody 10882 (IGHV3-33)
ARDQRYSSGWYDY

SEQ ID NO: 21765 - protein, 9 aa, Homo sapiens
  Light chain CDR3 for antibody 10883 (IGKV1-9)
QQLHSYPYT

SEQ ID NO: 21766 - protein, 23 aa, Homo sapiens
  Heavy chain CDR3 for antibody 10883 (IGHV3-11)
ARDEGVTMVRGVISYYYYYGMDV

SEQ ID NO: 21767 - protein, 9 aa, Homo sapiens
  Light chain CDR3 for antibody 10884 (IGKV2D-28)
MQALQTPYT

SEQ ID NO: 21768 - protein, 15 aa, Homo sapiens
  Heavy chain CDR3 for antibody 10884 (IGHV3-30)
ARRGYGSGSPDAFDL

SEQ ID NO: 21769 - protein, 10 aa, Homo sapiens
  Light chain CDR3 for antibody 10885 (IGKV1-17)
LQHNSYPMYT

SEQ ID NO: 21770 - protein, 13 aa, Homo sapiens
  Heavy chain CDR3 for antibody 10885 (IGHV3-33)
ASGYSGYDWYFDL

SEQ ID NO: 21771 - protein, 9 aa, Homo sapiens
  Light chain CDR3 for antibody 10886 (IGKV3-15)
QQYNNWPRT

SEQ ID NO: 21772 - protein, 18 aa, Homo sapiens
  Heavy chain CDR3 for antibody 10886 (IGHV3-33)
ARDRGDILTGYYKGWFDH

SEQ ID NO: 21773 - protein, 9 aa, Homo sapiens
  Light chain CDR3 for antibody 10887 (IGKV2D-28)
MQALQTPPT

SEQ ID NO: 21774 - protein, 13 aa, Homo sapiens
  Heavy chain CDR3 for antibody 10887 (IGHV3-23)
AKDRGGSYSYFDF

SEQ ID NO: 21775 - protein, 9 aa, Homo sapiens
  Light chain CDR3 for antibody 10888 (IGKV1-6)
LQDYNYPLT

SEQ ID NO: 21776 - protein, 9 aa, Homo sapiens
  Heavy chain CDR3 for antibody 10888 (IGHV3-30)
ARDYCHFDY

SEQ ID NO: 21777 - protein, 9 aa, Homo sapiens
  Light chain CDR3 for antibody 10889 (IGKV6-21)
HQSSSLPYT

SEQ ID NO: 21778 - protein, 12 aa, Homo sapiens
  Heavy chain CDR3 for antibody 10889 (IGHV4-28)
ARKDSGYDWFDY

SEQ ID NO: 21779 - protein, 9 aa, Homo sapiens
  Light chain CDR3 for antibody 10890 (IGKV1-39)
QQCYSTPFT

SEQ ID NO: 21780 - protein, 15 aa, Homo sapiens
  Heavy chain CDR3 for antibody 10890 (IGHV3-33)
ARDHLTGYYYYGMDV

SEQ ID NO: 21781 - protein, 9 aa, Homo sapiens
  Light chain CDR3 for antibody 10891 (IGKV1D-16)
QQYNSFPLT

SEQ ID NO: 21782 - protein, 12 aa, Homo sapiens
  Heavy chain CDR3 for antibody 10891 (IGHV4-61)
ARVDSSGWYFDY

SEQ ID NO: 21783 - protein, 9 aa, Homo sapiens
  Light chain CDR3 for antibody 10892 (IGKV1-17)
LQHNSYPYT

SEQ ID NO: 21784 - protein, 16 aa, Homo sapiens
  Heavy chain CDR3 for antibody 10892 (IGHV3-23)
AKEGMVLRYLDWFWDY

SEQ ID NO: 21785 - protein, 10 aa, Homo sapiens
  Light chain CDR3 for antibody 10893 (IGKV1-9)
QQFNSYPPYT

SEQ ID NO: 21786 - protein, 14 aa, Homo sapiens
  Heavy chain CDR3 for antibody 10893 (IGHV3-33)
ARDGRLTMVRGGDF

SEQ ID NO: 21787 - protein, 9 aa, Homo sapiens
  Light chain CDR3 for antibody 10894 (IGKV1-9)
QQLKSYLYT

SEQ ID NO: 21788 - protein, 11 aa, Homo sapiens
  Heavy chain CDR3 for antibody 10894 (IGHV3-33)
AREAANWGFDY

SEQ ID NO: 21789 - protein, 8 aa, Homo sapiens
  Light chain CDR3 for antibody 10895 (IGKV3D-7)
QQDYNLLT

SEQ ID NO: 21790 - protein, 17 aa, Homo sapiens
  Heavy chain CDR3 for antibody 10895 (IGHV3-23)
AKDTITMVRGALFGMDV

SEQ ID NO: 21791 - protein, 9 aa, Homo sapiens
  Light chain CDR3 for antibody 10896 (IGKV1-16)
QHYNDYPFT

SEQ ID NO: 21792 - protein, 16 aa, Homo sapiens
  Heavy chain CDR3 for antibody 10896 (IGHV3-33)
ARDGSMVRRIHDAFDF

SEQ ID NO: 21793 - protein, 9 aa, Homo sapiens
  Light chain CDR3 for antibody 10897 (IGKV1-6)
LQDYKSPFT

SEQ ID NO: 21794 - protein, 14 aa, Homo sapiens
  Heavy chain CDR3 for antibody 10897 (IGHV3-33)
ARDGIVRATDAFAI

SEQ ID NO: 21795 - protein, 9 aa, Homo sapiens
  Light chain CDR3 for antibody 10898 (IGKV1D-16)
QQYNSFPFT

SEQ ID NO: 21796 - protein, 17 aa, Homo sapiens
  Heavy chain CDR3 for antibody 10898 (IGHV3-33)
AREYNDILTGYWGYFDY

SEQ ID NO: 21797 - protein, 10 aa, Homo sapiens
  Light chain CDR3 for antibody 10899 (IGKV1-39)
QQSYSSPMYT

SEQ ID NO: 21798 - protein, 14 aa, Homo sapiens
  Heavy chain CDR3 for antibody 10899 (IGHV4-39)
ARDSGYDYYYAMDV

SEQ ID NO: 21799 - protein, 9 aa, Homo sapiens
  Light chain CDR3 for antibody 10900 (IGKV3D-7)
QQDYNLPLT

SEQ ID NO: 21800 - protein, 18 aa, Homo sapiens
  Heavy chain CDR3 for antibody 10900 (IGHV3-64)
ARDEYYYGSGSYYNYFDW

SEQ ID NO: 21801 - protein, 9 aa, Homo sapiens
  Light chain CDR3 for antibody 10901 (IGKV3D-7)
QQDYNLPYS

SEQ ID NO: 21802 - protein, 12 aa, Homo sapiens
  Heavy chain CDR3 for antibody 10901 (IGHV1-46)
AREDYDIDGMDV

SEQ ID NO: 21803 - protein, 9 aa, Homo sapiens
  Light chain CDR3 for antibody 10902 (IGKV6-21)
HQSSSLPYT

SEQ ID NO: 21804 - protein, 10 aa, Homo sapiens
  Heavy chain CDR3 for antibody 10902 (IGHV3-21)
ARETWWRFDP

SEQ ID NO: 21805 - protein, 9 aa, Homo sapiens
  Light chain CDR3 for antibody 10903 (IGKV1-6)
LQDYKSPFT

SEQ ID NO: 21806 - protein, 14 aa, Homo sapiens
  Heavy chain CDR3 for antibody 10903 (IGHV3-33)
ARDGYDILTGPFYY

SEQ ID NO: 21807 - protein, 9 aa, Homo sapiens
  Light chain CDR3 for antibody 10904 (IGKV2D-28)
MQALQTPPT

SEQ ID NO: 21808 - protein, 11 aa, Homo sapiens
  Heavy chain CDR3 for antibody 10904 (IGHV4-59)
AREMGHDIFDI

SEQ ID NO: 21809 - protein, 9 aa, Homo sapiens
  Light chain CDR3 for antibody 10905 (IGKV1-17)
LHSNNYPWT

SEQ ID NO: 21810 - protein, 12 aa, Homo sapiens
  Heavy chain CDR3 for antibody 10905 (IGHV1-46)
ARGLIGDHALDI

SEQ ID NO: 21811 - protein, 9 aa, Homo sapiens
  Light chain CDR3 for antibody 10906 (IGKV6-21)
HQSSTLPST

SEQ ID NO: 21812 - protein, 16 aa, Homo sapiens
  Heavy chain CDR3 for antibody 10906 (IGHV3-23)
AKEGMVLRYFDWLRDY

SEQ ID NO: 21813 - protein, 11 aa, Homo sapiens
  Light chain CDR3 for antibody 10907 (IGKV3-11)
QQRSNWPPMYT

SEQ ID NO: 21814 - protein, 19 aa, Homo sapiens
  Heavy chain CDR3 for antibody 10907 (IGHV1-18)
ARDDILTGYSLYYYYGMDV

SEQ ID NO: 21815 - protein, 9 aa, Homo sapiens
  Light chain CDR3 for antibody 10908 (IGKV6-21)
HQSSSLPYT

SEQ ID NO: 21816 - protein, 18 aa, Homo sapiens
  Heavy chain CDR3 for antibody 10908 (IGHV1-18)
ARDPNYYGSGSYYNYFGY

SEQ ID NO: 21817 - protein, 9 aa, Homo sapiens
  Light chain CDR3 for antibody 10909 (IGKV1-9)
QQLNGYPFT

SEQ ID NO: 21818 - protein, 18 aa, Homo sapiens
  Heavy chain CDR3 for antibody 10909 (IGHV1-18)
ARDRYYYDSGSYYYGMDV

SEQ ID NO: 21819 - protein, 9 aa, Homo sapiens
  Light chain CDR3 for antibody 10910 (IGKV1-33)
QQLNGYPFT

SEQ ID NO: 21820 - protein, 18 aa, Homo sapiens
  Heavy chain CDR3 for antibody 10910 (IGHV4-39)
ARGALTYYDILTGYFFDY

SEQ ID NO: 21821 - protein, 9 aa, Homo sapiens
  Light chain CDR3 for antibody 10911 (IGKV3-11)
QQRINWPWT

SEQ ID NO: 21822 - protein, 18 aa, Homo sapiens
  Heavy chain CDR3 for antibody 10911 (IGHV4-59)
ARDNHYYSSGAYSNWFDP

SEQ ID NO: 21823 - protein, 9 aa, Homo sapiens
  Light chain CDR3 for antibody 10912 (IGKV1-6)
LQDFHYPWT

SEQ ID NO: 21824 - protein, 17 aa, Homo sapiens
  Heavy chain CDR3 for antibody 10912 (IGHV4-59)
ARDFLVRGEGSYYGMDV

SEQ ID NO: 21825 - protein, 9 aa, Homo sapiens
  Light chain CDR3 for antibody 10913 (IGKV1-6)
LQDYKSPFT

SEQ ID NO: 21826 - protein, 13 aa, Homo sapiens
  Heavy chain CDR3 for antibody 10913 (IGHV3-53)
ARSGSYWGYYFDY

SEQ ID NO: 21827 - protein, 9 aa, Homo sapiens
  Light chain CDR3 for antibody 10914 (IGKV1D-13)
QQFNNYPHT

SEQ ID NO: 21828 - protein, 12 aa, Homo sapiens
  Heavy chain CDR3 for antibody 10914 (IGHV3-23)
AKGYTSFWYFDL

SEQ ID NO: 21829 - protein, 9 aa, Homo sapiens
  Light chain CDR3 for antibody 10915 (IGKV1D-13)
QQFNNYPHT

SEQ ID NO: 21830 - protein, 11 aa, Homo sapiens
  Heavy chain CDR3 for antibody 10915 (IGHV3-33)
ATERDMVRGDY

SEQ ID NO: 21831 - protein, 9 aa, Homo sapiens
  Light chain CDR3 for antibody 10916 (IGKV1-6)
LQDYNYPYT

SEQ ID NO: 21832 - protein, 14 aa, Homo sapiens
  Heavy chain CDR3 for antibody 10916 (IGHV3-33)
ARDHRDNSYYGMDV

SEQ ID NO: 21833 - protein, 9 aa, Homo sapiens
  Light chain CDR3 for antibody 10917 (IGKV1-9)
QQLHIYPWT

SEQ ID NO: 21834 - protein, 18 aa, Homo sapiens
  Heavy chain CDR3 for antibody 10917 (IGHV3-33)
VRDRERYGSGSYPDAFDI

SEQ ID NO: 21835 - protein, 7 aa, Homo sapiens
  Light chain CDR3 for antibody 10918 (IGKV1-17)
LQHNSYP

SEQ ID NO: 21836 - protein, 11 aa, Homo sapiens
  Heavy chain CDR3 for antibody 10918 (IGHV3-33)
ARDRSSGPFDY

SEQ ID NO: 21837 - protein, 10 aa, Homo sapiens
  Light chain CDR3 for antibody 10919 (IGKV1-6)
LQDYNYPMYT

SEQ ID NO: 21838 - protein, 16 aa, Homo sapiens
  Heavy chain CDR3 for antibody 10919 (IGHV3-33)
ARAVYYGSGSSLIMDV

SEQ ID NO: 21839 - protein, 9 aa, Homo sapiens
  Light chain CDR3 for antibody 10920 (IGKV1-17)
QQLNSYPRT

SEQ ID NO: 21840 - protein, 15 aa, Homo sapiens
  Heavy chain CDR3 for antibody 10920 (IGHV3-21)
ARDEHYDILTGYWAY

SEQ ID NO: 21841 - protein, 9 aa, Homo sapiens
  Light chain CDR3 for antibody 10921 (IGKV1-6)
LQDYKSPFT

SEQ ID NO: 21842 - protein, 18 aa, Homo sapiens
  Heavy chain CDR3 for antibody 10921 (IGHV3-33)
AREGSYYGSGSFPNWFDP

SEQ ID NO: 21843 - protein, 9 aa, Homo sapiens
  Light chain CDR3 for antibody 10922 (IGKV1-9)
QQLKSYLYT

SEQ ID NO: 21844 - protein, 20 aa, Homo sapiens
  Heavy chain CDR3 for antibody 10922 (IGHV3-11)
ARGGATLIRGLIDYYYGMDV

SEQ ID NO: 21845 - protein, 10 aa, Homo sapiens
  Light chain CDR3 for antibody 10923 (IGKV3-15)
QQYNNWPPIT

SEQ ID NO: 21846 - protein, 14 aa, Homo sapiens
  Heavy chain CDR3 for antibody 10923 (IGHV1-2)
ARDYYGSGNYYMGY

SEQ ID NO: 21847 - protein, 9 aa, Homo sapiens
  Light chain CDR3 for antibody 10924 (IGKV1-39)
QQSYSTPYT

SEQ ID NO: 21848 - protein, 14 aa, Homo sapiens
  Heavy chain CDR3 for antibody 10924 (IGHV3-33)
ARDDYVSGSYYFDY

SEQ ID NO: 21849 - protein, 9 aa, Homo sapiens
  Light chain CDR3 for antibody 10925 (IGKV3-11)
QQRSNWMYT

SEQ ID NO: 21850 - protein, 14 aa, Homo sapiens
  Heavy chain CDR3 for antibody 10925 (IGHV4-39)
ARHGYYGSSNWFDP

SEQ ID NO: 21851 - protein, 9 aa, Homo sapiens
  Light chain CDR3 for antibody 10926 (IGKV1D-13)
QHFNNYMYT

SEQ ID NO: 21852 - protein, 16 aa, Homo sapiens
  Heavy chain CDR3 for antibody 10926 (IGHV3-33)
ARGYDMLTGDYHCMDV

SEQ ID NO: 21853 - protein, 8 aa, Homo sapiens
  Light chain CDR3 for antibody 10927 (IGKV3-15)
QQYNNWPT

SEQ ID NO: 21854 - protein, 12 aa, Homo sapiens
  Heavy chain CDR3 for antibody 10927 (IGHV3-13)
AREAGIPDAFDI

SEQ ID NO: 21855 - protein, 9 aa, Homo sapiens
  Light chain CDR3 for antibody 10928 (IGKV1-33)
QQYDNLPFT

SEQ ID NO: 21856 - protein, 16 aa, Homo sapiens
  Heavy chain CDR3 for antibody 10928 (IGHV3-33)
ARAVYYGSGSSLIMDV

SEQ ID NO: 21857 - protein, 10 aa, Homo sapiens
  Light chain CDR3 for antibody 10929 (IGKV3-11)
QQRSNWPMYT

SEQ ID NO: 21858 - protein, 12 aa, Homo sapiens
  Heavy chain CDR3 for antibody 10929 (IGHV3-33)
ARVDAAAPYFDY

SEQ ID NO: 21859 - protein, 9 aa, Homo sapiens
  Light chain CDR3 for antibody 10930 (IGKV1D-16)
QQYHSYPYT

SEQ ID NO: 21860 - protein, 19 aa, Homo sapiens
  Heavy chain CDR3 for antibody 10930 (IGHV3-20)
ARDSAVAGRYYYYYYGMDV

SEQ ID NO: 21861 - protein, 8 aa, Homo sapiens
  Light chain CDR3 for antibody 10931 (IGKV1D-13)
QQYNNYPT

SEQ ID NO: 21862 - protein, 12 aa, Homo sapiens
  Heavy chain CDR3 for antibody 10931 (IGHV3-33)
ASRDILTGYLGY

SEQ ID NO: 21863 - protein, 9 aa, Homo sapiens
  Light chain CDR3 for antibody 10932 (IGKV1-17)
LQHNGYPLT

SEQ ID NO: 21864 - protein, 11 aa, Homo sapiens
  Heavy chain CDR3 for antibody 10932 (IGHV3-33)
ARDRISGPFDY

SEQ ID NO: 21865 - protein, 9 aa, Homo sapiens
  Light chain CDR3 for antibody 10933 (IGKV1-6)
LQDYNYPWT

SEQ ID NO: 21866 - protein, 10 aa, Homo sapiens
  Heavy chain CDR3 for antibody 10933 (IGHV3-33)
ARDPSGCFDY

SEQ ID NO: 21867 - protein, 10 aa, Homo sapiens
  Light chain CDR3 for antibody 10934 (IGKV1-17)
LQHNSYPMYT

SEQ ID NO: 21868 - protein, 15 aa, Homo sapiens
  Heavy chain CDR3 for antibody 10934 (IGHV1-46)
ARGAVDDYYYYGMDV

SEQ ID NO: 21869 - protein, 9 aa, Homo sapiens
  Light chain CDR3 for antibody 10935 (IGKV1-39)
QQSYSTPFT

SEQ ID NO: 21870 - protein, 12 aa, Homo sapiens
  Heavy chain CDR3 for antibody 10935 (IGHV4-39)
ASLGWELHDFDY

SEQ ID NO: 21871 - protein, 9 aa, Homo sapiens
  Light chain CDR3 for antibody 10936 (IGKV1-9)
QQLNTYPWT

SEQ ID NO: 21872 - protein, 14 aa, Homo sapiens
  Heavy chain CDR3 for antibody 10936 (IGHV3-33)
ARDGYDFLTGPFDY

SEQ ID NO: 21873 - protein, 9 aa, Homo sapiens
  Light chain CDR3 for antibody 10937 (IGKV1-6)
LQDYKHPFT

SEQ ID NO: 21874 - protein, 10 aa, Homo sapiens
  Heavy chain CDR3 for antibody 10937 (IGHV3-23)
AKDHYGDYPY

SEQ ID NO: 21875 - protein, 6 aa, Homo sapiens
  Light chain CDR3 for antibody 10938 (IGKV3-20)
QQYGST

SEQ ID NO: 21876 - protein, 17 aa, Homo sapiens
  Heavy chain CDR3 for antibody 10938 (IGHV3-33)
ARGFSGYDGYYYYGMDV

SEQ ID NO: 21877 - protein, 10 aa, Homo sapiens
  Light chain CDR3 for antibody 10939 (IGKV1-39)
QQSYSTPMYT

SEQ ID NO: 21878 - protein, 15 aa, Homo sapiens
  Heavy chain CDR3 for antibody 10939 (IGHV3-33)
VCVLYDYGDYVGFDY

SEQ ID NO: 21879 - protein, 9 aa, Homo sapiens
  Light chain CDR3 for antibody 10940 (IGKV3-20)
QRYGSSPYT

SEQ ID NO: 21880 - protein, 17 aa, Homo sapiens
  Heavy chain CDR3 for antibody 10940 (IGHV1-18)
ARDRASTMVRGVPPFDY

SEQ ID NO: 21881 - protein, 9 aa, Homo sapiens
  Light chain CDR3 for antibody 10941 (IGKV1-6)
LQDYKSPFT

SEQ ID NO: 21882 - protein, 14 aa, Homo sapiens
  Heavy chain CDR3 for antibody 10941 (IGHV3-33)
ARDLDIMATSPFAY

SEQ ID NO: 21883 - protein, 9 aa, Homo sapiens
  Light chain CDR3 for antibody 10942 (IGKV1-6)
QQEYNYPLT

SEQ ID NO: 21884 - protein, 13 aa, Homo sapiens
  Heavy chain CDR3 for antibody 10942 (IGHV3-53)
ARSGSYWGYYFDY

SEQ ID NO: 21885 - protein, 9 aa, Homo sapiens
  Light chain CDR3 for antibody 10943 (IGKV1D-16)
QQYITYPYT

SEQ ID NO: 21886 - protein, 18 aa, Homo sapiens
  Heavy chain CDR3 for antibody 10943 (IGHV3-64)
AREGDYYGSGGFPNWFDP

SEQ ID NO: 21887 - protein, 9 aa, Homo sapiens
  Light chain CDR3 for antibody 10944 (IGKV3-20)
QQYGSSPYT

SEQ ID NO: 21888 - protein, 12 aa, Homo sapiens
  Heavy chain CDR3 for antibody 10944 (IGHV3-9)
AEDPFLGTSFDY

SEQ ID NO: 21889 - protein, 9 aa, Homo sapiens
  Light chain CDR3 for antibody 10945 (IGKV4-1)
QQYYSTPWT

SEQ ID NO: 21890 - protein, 14 aa, Homo sapiens
  Heavy chain CDR3 for antibody 10945 (IGHV3-33)
ARDLNYDILNGGGY

SEQ ID NO: 21891 - protein, 9 aa, Homo sapiens
  Light chain CDR3 for antibody 10946 (IGKV1-17)
LQHNSYPLT

SEQ ID NO: 21892 - protein, 12 aa, Homo sapiens
  Heavy chain CDR3 for antibody 10946 (IGHV3-33)
ARDRAYRGSLDH

SEQ ID NO: 21893 - protein, 8 aa, Homo sapiens
  Light chain CDR3 for antibody 10947 (IGKV3-20)
QQYGSSLT

SEQ ID NO: 21894 - protein, 18 aa, Homo sapiens
  Heavy chain CDR3 for antibody 10947 (IGHV3-33)
ARDQYSGYDYYYYYGMDV

SEQ ID NO: 21895 - protein, 9 aa, Homo sapiens
  Light chain CDR3 for antibody 10948 (IGKV3-20)
QQYGSSPRT

SEQ ID NO: 21896 - protein, 13 aa, Homo sapiens
  Heavy chain CDR3 for antibody 10948 (IGHV3-33)
TRRIAVAGAEGDY

SEQ ID NO: 21897 - protein, 8 aa, Homo sapiens
  Light chain CDR3 for antibody 10949 (IGKV3-20)
QQYGSSLT

SEQ ID NO: 21898 - protein, 11 aa, Homo sapiens
  Heavy chain CDR3 for antibody 10949 (IGHV3-23)
ARDPGSITGDY

SEQ ID NO: 21899 - protein, 9 aa, Homo sapiens
  Light chain CDR3 for antibody 10950 (IGKV1-37)
QRTSNAPYT

SEQ ID NO: 21900 - protein, 12 aa, Homo sapiens
  Heavy chain CDR3 for antibody 10950 (IGHV3-33)
ARGYFGSGYAHF

SEQ ID NO: 21901 - protein, 9 aa, Homo sapiens
  Light chain CDR3 for antibody 10951 (IGKV3D-20)
QQYHSYPYT

SEQ ID NO: 21902 - protein, 15 aa, Homo sapiens
  Heavy chain CDR3 for antibody 10951 (IGHV3-33)
ARDRVGVKDYYSMDV

SEQ ID NO: 21903 - protein, 9 aa, Homo sapiens
  Light chain CDR3 for antibody 10952 (IGKV1-6)
LQDYKHPFT

SEQ ID NO: 21904 - protein, 21 aa, Homo sapiens
  Heavy chain CDR3 for antibody 10952 (IGHV3-33)
ARKRLYDILTGYYKAYYGMDV

SEQ ID NO: 21905 - protein, 10 aa, Homo sapiens
  Light chain CDR3 for antibody 10953 (IGKV3-15)
QQYNNWPPYT

SEQ ID NO: 21906 - protein, 13 aa, Homo sapiens
  Heavy chain CDR3 for antibody 10953 (IGHV3-33)
ARRYRSGWYPFDY

SEQ ID NO: 21907 - protein, 9 aa, Homo sapiens
  Light chain CDR3 for antibody 10954 (IGKV3D-7)
QQDYKLPRT

SEQ ID NO: 21908 - protein, 13 aa, Homo sapiens
  Heavy chain CDR3 for antibody 10954 (IGHV3-33)
ARVHFDWLDAFDI

SEQ ID NO: 21909 - protein, 9 aa, Homo sapiens
  Light chain CDR3 for antibody 10955 (IGKV1-17)
LQHNGYPLT

SEQ ID NO: 21910 - protein, 17 aa, Homo sapiens
  Heavy chain CDR3 for antibody 10955 (IGHV4-59)
ARDFLVRGEGSYYGMDV

SEQ ID NO: 21911 - protein, 9 aa, Homo sapiens
  Light chain CDR3 for antibody 10956 (IGKV3-11)
QQRSNWMYT

SEQ ID NO: 21912 - protein, 14 aa, Homo sapiens
  Heavy chain CDR3 for antibody 10956 (IGHV3-23)
AKGGDILTGYYPDY

SEQ ID NO: 21913 - protein, 8 aa, Homo sapiens
  Light chain CDR3 for antibody 10957 (IGKV1-5)
QQYHSYYT

SEQ ID NO: 21914 - protein, 9 aa, Homo sapiens
  Heavy chain CDR3 for antibody 10957 (IGHV1-8)
ARGRLDFDY

SEQ ID NO: 21915 - protein, 10 aa, Homo sapiens
  Light chain CDR3 for antibody 10958 (IGKV1-17)
LQHNSYPMYT

SEQ ID NO: 21916 - protein, 18 aa, Homo sapiens
  Heavy chain CDR3 for antibody 10958 (IGHV3-23)
AKVGDFFASGNYWDYFDY

SEQ ID NO: 21917 - protein, 8 aa, Homo sapiens
  Light chain CDR3 for antibody 10959 (IGKV1D-13)
QQFNNYPT

SEQ ID NO: 21918 - protein, 18 aa, Homo sapiens
  Heavy chain CDR3 for antibody 10959 (IGHV3-33)
ARGGVLYDILTGFYGMDV

SEQ ID NO: 21919 - protein, 9 aa, Homo sapiens
  Light chain CDR3 for antibody 10960 (IGKV1-6)
LQDFHYPWT

SEQ ID NO: 21920 - protein, 17 aa, Homo sapiens
  Heavy chain CDR3 for antibody 10960 (IGHV3-h)
ARGEQWLGYYYYYGMDV

SEQ ID NO: 21921 - protein, 9 aa, Homo sapiens
  Light chain CDR3 for antibody 10961 (IGKV1-16)
QKYNSAPHT

SEQ ID NO: 21922 - protein, 13 aa, Homo sapiens
  Heavy chain CDR3 for antibody 10961 (IGHV3-33)
ASGYSGYDWYFDL

SEQ ID NO: 21923 - protein, 9 aa, Homo sapiens
  Light chain CDR3 for antibody 10962 (IGKV1-39)
QQSYSTPLT

SEQ ID NO: 21924 - protein, 15 aa, Homo sapiens
  Heavy chain CDR3 for antibody 10962 (IGHV3-23)
AKDPRGYYYYYGMDV

SEQ ID NO: 21925 - protein, 9 aa, Homo sapiens
  Light chain CDR3 for antibody 10963 (IGKV2D-28)
MQALQTPPT

SEQ ID NO: 21926 - protein, 8 aa, Homo sapiens
  Heavy chain CDR3 for antibody 10963 (IGHV3-23)
EKSAGEDV

SEQ ID NO: 21927 - protein, 9 aa, Homo sapiens
  Light chain CDR3 for antibody 10964 (IGKV3D-20)
QQYGSSPRT

SEQ ID NO: 21928 - protein, 18 aa, Homo sapiens
  Heavy chain CDR3 for antibody 10964 (IGHV3-33)
ARDPYSSGWYDYYFGMDV

SEQ ID NO: 21929 - protein, 9 aa, Homo sapiens
  Light chain CDR3 for antibody 10965 (IGKV1-9)
QQLTSYPWT

SEQ ID NO: 21930 - protein, 17 aa, Homo sapiens
  Heavy chain CDR3 for antibody 10965 (IGHV3-33)
AREDGDILTGYYEWFDP

SEQ ID NO: 21931 - protein, 10 aa, Homo sapiens
  Light chain CDR3 for antibody 10966 (IGKV3-15)
QQYNNWPPLT

SEQ ID NO: 21932 - protein, 14 aa, Homo sapiens
  Heavy chain CDR3 for antibody 10966 (IGHV3-33)
ARDKSYPLSYGMDV

SEQ ID NO: 21933 - protein, 9 aa, Homo sapiens
  Light chain CDR3 for antibody 10967 (IGKV1-17)
LQQNDYPWT

SEQ ID NO: 21934 - protein, 17 aa, Homo sapiens
  Heavy chain CDR3 for antibody 10967 (IGHV4-59)
ARRITMVREIIITAFDY

SEQ ID NO: 21935 - protein, 9 aa, Homo sapiens
  Light chain CDR3 for antibody 10968 (IGKV1D-13)
QQFNNYPYT

SEQ ID NO: 21936 - protein, 11 aa, Homo sapiens
  Heavy chain CDR3 for antibody 10968 (IGHV3-33)
ARDILTGYFDY

SEQ ID NO: 21937 - protein, 9 aa, Homo sapiens
  Light chain CDR3 for antibody 10969 (IGKV1D-13)
QRFNNYLYT

SEQ ID NO: 21938 - protein, 15 aa, Homo sapiens
  Heavy chain CDR3 for antibody 10969 (IGHV3-23)
AKEALRYFDWSGMDV

SEQ ID NO: 21939 - protein, 8 aa, Homo sapiens
  Light chain CDR3 for antibody 10970 (IGKV3-20)
QQYGSSLT

SEQ ID NO: 21940 - protein, 10 aa, Homo sapiens
  Heavy chain CDR3 for antibody 10970 (IGHV3-23)
AKEQWLVLDY

SEQ ID NO: 21941 - protein, 10 aa, Homo sapiens
  Light chain CDR3 for antibody 10971 (IGKV1-39)
QQSYSTPMYT

SEQ ID NO: 21942 - protein, 19 aa, Homo sapiens
  Heavy chain CDR3 for antibody 10971 (IGHV3-30)
ARRFSGYSGYDHYYYGMDV

SEQ ID NO: 21943 - protein, 9 aa, Homo sapiens
  Light chain CDR3 for antibody 10972 (IGKV1-17)
LQHNGYPLT

SEQ ID NO: 21944 - protein, 15 aa, Homo sapiens
  Heavy chain CDR3 for antibody 10972 (IGHV3-30)
ARGAMGRGVDYGMDV

SEQ ID NO: 21945 - protein, 9 aa, Homo sapiens
  Light chain CDR3 for antibody 10973 (IGKV1D-13)
QQFNNYPST

SEQ ID NO: 21946 - protein, 18 aa, Homo sapiens
  Heavy chain CDR3 for antibody 10973 (IGHV3-23)
AKDGDYFGSGSYWGYFDL

SEQ ID NO: 21947 - protein, 9 aa, Homo sapiens
  Light chain CDR3 for antibody 10974 (IGKV3D-7)
QQDYTLPLT

SEQ ID NO: 21948 - protein, 19 aa, Homo sapiens
  Heavy chain CDR3 for antibody 10974 (IGHV1-18)
ARGGHIGVVTAFHGYGMDV

SEQ ID NO: 21949 - protein, 9 aa, Homo sapiens
  Light chain CDR3 for antibody 10975 (IGKV3D-7)
QQDYNLPLT

SEQ ID NO: 21950 - protein, 11 aa, Homo sapiens
  Heavy chain CDR3 for antibody 10975 (IGHV3-23)
AKEGTYFDIPH

SEQ ID NO: 21951 - protein, 9 aa, Homo sapiens
  Light chain CDR3 for antibody 10976 (IGKV1-6)
LQDYSYPFT

SEQ ID NO: 21952 - protein, 13 aa, Homo sapiens
  Heavy chain CDR3 for antibody 10976 (IGHV3-33)
ARRATLVRGVFDH

SEQ ID NO: 21953 - protein, 9 aa, Homo sapiens
  Light chain CDR3 for antibody 10977 (IGKV1-39)
QQSYSTPLT

SEQ ID NO: 21954 - protein, 11 aa, Homo sapiens
  Heavy chain CDR3 for antibody 10977 (IGHV3-33)
ARDRATAGLDY

SEQ ID NO: 21955 - protein, 10 aa, Homo sapiens
  Light chain CDR3 for antibody 10978 (IGKV3-20)
QQYGRSPPVT

SEQ ID NO: 21956 - protein, 11 aa, Homo sapiens
  Heavy chain CDR3 for antibody 10978 (IGHV3-33)
ARARYTTGLDY

SEQ ID NO: 21957 - protein, 8 aa, Homo sapiens
  Light chain CDR3 for antibody 10979 (IGKV3-20)
QQYGSSLT

SEQ ID NO: 21958 - protein, 18 aa, Homo sapiens
  Heavy chain CDR3 for antibody 10979 (IGHV3-53)
AKAGDYYVSGSYWGYFDL

SEQ ID NO: 21959 - protein, 9 aa, Homo sapiens
  Light chain CDR3 for antibody 10980 (IGKV3D-20)
QQYGRSPRT

SEQ ID NO: 21960 - protein, 16 aa, Homo sapiens
  Heavy chain CDR3 for antibody 10980 (IGHV1-24)
ARGRYYEWLLGDVFDI

SEQ ID NO: 21961 - protein, 9 aa, Homo sapiens
  Light chain CDR3 for antibody 10981 (IGKV1-9)
QQLNNYLFT

SEQ ID NO: 21962 - protein, 11 aa, Homo sapiens
  Heavy chain CDR3 for antibody 10981 (IGHV4-39)
ARLLVGATTDY

SEQ ID NO: 21963 - protein, 9 aa, Homo sapiens
  Light chain CDR3 for antibody 10982 (IGKV3D-7)
QQDYTLPLT

SEQ ID NO: 21964 - protein, 17 aa, Homo sapiens
  Heavy chain CDR3 for antibody 10982 (IGHV3-33)
TRDSGMVRGIIIYGMDV

SEQ ID NO: 21965 - protein, 9 aa, Homo sapiens
  Light chain CDR3 for antibody 10983 (IGKV6-21)
HQSSSLPYT

SEQ ID NO: 21966 - protein, 16 aa, Homo sapiens
  Heavy chain CDR3 for antibody 10983 (IGHV3-33)
ARGFSGYDGYYYGMDV

SEQ ID NO: 21967 - protein, 8 aa, Homo sapiens
  Light chain CDR3 for antibody 10984 (IGKV1D-13)
QQFNNYPT

SEQ ID NO: 21968 - protein, 18 aa, Homo sapiens
  Heavy chain CDR3 for antibody 10984 (IGHV3-33)
AREGYFGSGSYYRNWFDP

SEQ ID NO: 21969 - protein, 9 aa, Homo sapiens
  Light chain CDR3 for antibody 10985 (IGKV5-2)
LQHYNFPYT

SEQ ID NO: 21970 - protein, 10 aa, Homo sapiens
  Heavy chain CDR3 for antibody 10985 (IGHV3-33)
ARDLGYNFDY

SEQ ID NO: 21971 - protein, 9 aa, Homo sapiens
  Light chain CDR3 for antibody 10986 (IGKV3D-7)
QQDYNLPYT

SEQ ID NO: 21972 - protein, 13 aa, Homo sapiens
  Heavy chain CDR3 for antibody 10986 (IGHV3-33)
ARQSSGWFDAFDI

SEQ ID NO: 21973 - protein, 9 aa, Homo sapiens
  Light chain CDR3 for antibody 10987 (IGKV6-21)
QQSSNLPHT

SEQ ID NO: 21974 - protein, 13 aa, Homo sapiens
  Heavy chain CDR3 for antibody 10987 (IGHV3-11)
ARSGSYWGYYFDY

SEQ ID NO: 21975 - protein, 10 aa, Homo sapiens
  Light chain CDR3 for antibody 10988 (IGKV1-27)
QKYNSAPMYT

SEQ ID NO: 21976 - protein, 15 aa, Homo sapiens
  Heavy chain CDR3 for antibody 10988 (IGHV4-39)
ARRSKYSSAWYPFDY

SEQ ID NO: 21977 - protein, 9 aa, Homo sapiens
  Light chain CDR3 for antibody 10989 (IGKV1D-13)
QQFNNYPYT

SEQ ID NO: 21978 - protein, 17 aa, Homo sapiens
  Heavy chain CDR3 for antibody 10989 (IGHV3-33)
ARSPYDILTGYSYYFDY

SEQ ID NO: 21979 - protein, 9 aa, Homo sapiens
  Light chain CDR3 for antibody 10990 (IGKV1-17)
LQHNSFPLT

SEQ ID NO: 21980 - protein, 20 aa, Homo sapiens
  Heavy chain CDR3 for antibody 10990 (IGHV3-30)
ARVGATLIRGLIDYYYGMDV

SEQ ID NO: 21981 - protein, 9 aa, Homo sapiens
  Light chain CDR3 for antibody 10991 (IGKV1-9)
QQLKSYLYT

SEQ ID NO: 21982 - protein, 20 aa, Homo sapiens
  Heavy chain CDR3 for antibody 10991 (IGHV3-33)
SRGGATLVRGVIDYYYGMDV

SEQ ID NO: 21983 - protein, 9 aa, Homo sapiens
  Light chain CDR3 for antibody 10992 (IGKV1-16)
LQHNSYPYT

SEQ ID NO: 21984 - protein, 12 aa, Homo sapiens
  Heavy chain CDR3 for antibody 10992 (IGHV4-39)
ARQGAYSRFFDY

SEQ ID NO: 21985 - protein, 10 aa, Homo sapiens
  Light chain CDR3 for antibody 10993 (IGKV1-17)
QQSYSTPMYT

SEQ ID NO: 21986 - protein, 12 aa, Homo sapiens
  Heavy chain CDR3 for antibody 10993 (IGHV4-59)
ARDRSGWAYFDY

SEQ ID NO: 21987 - protein, 9 aa, Homo sapiens
  Light chain CDR3 for antibody 10994 (IGKV1-16)
QQYYSYPRT

SEQ ID NO: 21988 - protein, 17 aa, Homo sapiens
  Heavy chain CDR3 for antibody 10994 (IGHV1-18)
ARVRAFTMVRGVPPFDY

SEQ ID NO: 21989 - protein, 9 aa, Homo sapiens
  Light chain CDR3 for antibody 10995 (IGKV3D-7)
QQDYNLPYT

SEQ ID NO: 21990 - protein, 13 aa, Homo sapiens
  Heavy chain CDR3 for antibody 10995 (IGHV4-39)
APFRVMVRGVLDY

SEQ ID NO: 21991 - protein, 9 aa, Homo sapiens
  Light chain CDR3 for antibody 10996 (IGKV1-6)
LQDYKSPFT

SEQ ID NO: 21992 - protein, 13 aa, Homo sapiens
  Heavy chain CDR3 for antibody 10996 (IGHV3-33)
ARVDTMVRGVMAY

SEQ ID NO: 21993 - protein, 8 aa, Homo sapiens
  Light chain CDR3 for antibody 10997 (IGKV1-5)
QQYNSYYT

SEQ ID NO: 21994 - protein, 15 aa, Homo sapiens
  Heavy chain CDR3 for antibody 10997 (IGHV3-23)
AKDPRGYYYYYGMDV

SEQ ID NO: 21995 - protein, 9 aa, Homo sapiens
  Light chain CDR3 for antibody 10998 (IGKV1D-13)
QRFNNYLYT

SEQ ID NO: 21996 - protein, 14 aa, Homo sapiens
  Heavy chain CDR3 for antibody 10998 (IGHV3-33)
ARAISGSAYWYFDL

SEQ ID NO: 21997 - protein, 9 aa, Homo sapiens
  Light chain CDR3 for antibody 10999 (IGKV3-11)
QQRINWPWT

SEQ ID NO: 21998 - protein, 13 aa, Homo sapiens
  Heavy chain CDR3 for antibody 10999 (IGHV4-61)
ARHPPSRDYGMDV

SEQ ID NO: 21999 - protein, 9 aa, Homo sapiens
  Light chain CDR3 for antibody 11000 (IGKV1-17)
QQYDSYPWT

SEQ ID NO: 22000 - protein, 17 aa, Homo sapiens
  Heavy chain CDR3 for antibody 11000 (IGHV3-33)
ARGYCSRTSCYLYYLDY

SEQ ID NO: 22001 - protein, 9 aa, Homo sapiens
  Light chain CDR3 for antibody 11001 (IGKV3-11)
QQFNNYPST

SEQ ID NO: 22002 - protein, 15 aa, Homo sapiens
  Heavy chain CDR3 for antibody 11001 (IGHV3-74)
ARGSGSHYHYYGMDV

SEQ ID NO: 22003 - protein, 8 aa, Homo sapiens
  Light chain CDR3 for antibody 11002 (IGKV3D-7)
QQDYNLLT

SEQ ID NO: 22004 - protein, 13 aa, Homo sapiens
  Heavy chain CDR3 for antibody 11002 (IGHV4-59)
ANRDYYGYYGMDV

SEQ ID NO: 22005 - protein, 9 aa, Homo sapiens
  Light chain CDR3 for antibody 11003 (IGKV1-16)
QHYNDYPFT

SEQ ID NO: 22006 - protein, 13 aa, Homo sapiens
  Heavy chain CDR3 for antibody 11003 (IGHV1-18)
ARSITMVRGVIGY

SEQ ID NO: 22007 - protein, 9 aa, Homo sapiens
  Light chain CDR3 for antibody 11004 (IGKV3-15)
QQYNNWPLT

SEQ ID NO: 22008 - protein, 18 aa, Homo sapiens
  Heavy chain CDR3 for antibody 11004 (IGHV3-33)
ARKGGYYSGSGSYRHFDF

SEQ ID NO: 22009 - protein, 9 aa, Homo sapiens
  Light chain CDR3 for antibody 11005 (IGKV1D-16)
QQYNSYPYT

SEQ ID NO: 22010 - protein, 15 aa, Homo sapiens
  Heavy chain CDR3 for antibody 11005 (IGHV3-15)
TTGWVRYCSGGCCRI

SEQ ID NO: 22011 - protein, 9 aa, Homo sapiens
  Light chain CDR3 for antibody 11006 (IGKV1-9)
QQLKSYMYT

SEQ ID NO: 22012 - protein, 13 aa, Homo sapiens
  Heavy chain CDR3 for antibody 11006 (IGHV3-66)
ANTGDSYYYGFYV

SEQ ID NO: 22013 - protein, 8 aa, Homo sapiens
  Light chain CDR3 for antibody 11007 (IGKV3-11)
QQRSNWLT

SEQ ID NO: 22014 - protein, 12 aa, Homo sapiens
  Heavy chain CDR3 for antibody 11007 (IGHV3-23)
AKEGLGSDYEPY

SEQ ID NO: 22015 - protein, 9 aa, Homo sapiens
  Light chain CDR3 for antibody 11008 (IGKV1-6)
LQDYNYPYT

SEQ ID NO: 22016 - protein, 14 aa, Homo sapiens
  Heavy chain CDR3 for antibody 11008 (IGHV3-20)
ARGRITMVRGVIDF

SEQ ID NO: 22017 - protein, 9 aa, Homo sapiens
  Light chain CDR3 for antibody 11009 (IGKV1-9)
QQLISYPLT

SEQ ID NO: 22018 - protein, 18 aa, Homo sapiens
  Heavy chain CDR3 for antibody 11009 (IGHV3-33)
VREGGYYGSGSYPDAFDI

SEQ ID NO: 22019 - protein, 9 aa, Homo sapiens
  Light chain CDR3 for antibody 11010 (IGKV1-9)
QQLYTYPYT

SEQ ID NO: 22020 - protein, 13 aa, Homo sapiens
  Heavy chain CDR3 for antibody 11010 (IGHV3-33)
ARDQRYSSGWYDY

SEQ ID NO: 22021 - protein, 6 aa, Homo sapiens
  Light chain CDR3 for antibody 11011 (IGKV3-20)
QQYGST

SEQ ID NO: 22022 - protein, 14 aa, Homo sapiens
  Heavy chain CDR3 for antibody 11011 (IGHV4-34)
ARDSGYDYYYGMDV

SEQ ID NO: 22023 - protein, 8 aa, Homo sapiens
  Light chain CDR3 for antibody 11012 (IGKV3-11)
QQRSNWWT

SEQ ID NO: 22024 - protein, 17 aa, Homo sapiens
  Heavy chain CDR3 for antibody 11012 (IGHV3-33)
AREGGLLWVGELSLFDY

SEQ ID NO: 22025 - protein, 7 aa, Homo sapiens
  Light chain CDR3 for antibody 11013 (IGKV1-17)
LQHNSYP

SEQ ID NO: 22026 - protein, 18 aa, Homo sapiens
  Heavy chain CDR3 for antibody 11013 (IGHV4-59)
ARERGNWNDVDYYYGMDV

SEQ ID NO: 22027 - protein, 9 aa, Homo sapiens
  Light chain CDR3 for antibody 11014 (IGKV1-9)
QQYNTYSRT

SEQ ID NO: 22028 - protein, 18 aa, Homo sapiens
  Heavy chain CDR3 for antibody 11014 (IGHV1-46)
ARDGDYVWGSYRSDWFDP

SEQ ID NO: 22029 - protein, 9 aa, Homo sapiens
  Light chain CDR3 for antibody 11015 (IGKV1-9)
QQLNSYPLT

SEQ ID NO: 22030 - protein, 13 aa, Homo sapiens
  Heavy chain CDR3 for antibody 11015 (IGHV4-59)
ARDAAYGCSCFDY

SEQ ID NO: 22031 - protein, 8 aa, Homo sapiens
  Light chain CDR3 for antibody 11016 (IGKV3-20)
QQYGSSLT

SEQ ID NO: 22032 - protein, 13 aa, Homo sapiens
  Heavy chain CDR3 for antibody 11016 (IGHV3-23)
AKDRGYSSTSTAY

SEQ ID NO: 22033 - protein, 9 aa, Homo sapiens
  Light chain CDR3 for antibody 11017 (IGKV4-1)
QQYYSYPLT

SEQ ID NO: 22034 - protein, 17 aa, Homo sapiens
  Heavy chain CDR3 for antibody 11017 (IGHV3-23)
ANGGFGESHYNYYGMDV

SEQ ID NO: 22035 - protein, 8 aa, Homo sapiens
  Light chain CDR3 for antibody 11018 (IGKV1D-13)
QQFNNYPT

SEQ ID NO: 22036 - protein, 20 aa, Homo sapiens
  Heavy chain CDR3 for antibody 11018 (IGHV3-33)
AREDYYGSGSYYPAYNWFDP

SEQ ID NO: 22037 - protein, 10 aa, Homo sapiens
  Light chain CDR3 for antibody 11019 (IGKV1-17)
LQHNSYPMYT

SEQ ID NO: 22038 - protein, 17 aa, Homo sapiens
  Heavy chain CDR3 for antibody 11019 (IGHV3-23)
AKDGIGELSYYYYCMDV

SEQ ID NO: 22039 - protein, 9 aa, Homo sapiens
  Light chain CDR3 for antibody 11020 (IGKV6-21)
HQSSSLPHT

SEQ ID NO: 22040 - protein, 19 aa, Homo sapiens
  Heavy chain CDR3 for antibody 11020 (IGHV3-33)
ATEGGIVGGTRYYYYGMDV

SEQ ID NO: 22041 - protein, 9 aa, Homo sapiens
  Light chain CDR3 for antibody 11021 (IGKV3-20)
QQYGTSPFP

SEQ ID NO: 22042 - protein, 20 aa, Homo sapiens
  Heavy chain CDR3 for antibody 11021 (IGHV3-33)
ARDRCSSTSCYGYYYYGMDV

SEQ ID NO: 22043 - protein, 9 aa, Homo sapiens
  Light chain CDR3 for antibody 11022 (IGKV6-21)
QQSSNLPHT

SEQ ID NO: 22044 - protein, 15 aa, Homo sapiens
  Heavy chain CDR3 for antibody 11022 (IGHV3-33)
ARDTGYSSSWNWFDP

SEQ ID NO: 22045 - protein, 9 aa, Homo sapiens
  Light chain CDR3 for antibody 11023 (IGKV1-27)
QKYNSAPYT

SEQ ID NO: 22046 - protein, 19 aa, Homo sapiens
  Heavy chain CDR3 for antibody 11023 (IGHV3-20)
ARDSAVAGRYYYYYYGMDV

SEQ ID NO: 22047 - protein, 9 aa, Homo sapiens
  Light chain CDR3 for antibody 11024 (IGKV3-15)
QQYNSYPRT

SEQ ID NO: 22048 - protein, 14 aa, Homo sapiens
  Heavy chain CDR3 for antibody 11024 (IGHV3-33)
AREMVRGVPNWFDP

SEQ ID NO: 22049 - protein, 9 aa, Homo sapiens
  Light chain CDR3 for antibody 11025 (IGKV6-21)
HQSSSLPST

SEQ ID NO: 22050 - protein, 18 aa, Homo sapiens
  Heavy chain CDR3 for antibody 11025 (IGHV3-33)
ARDPYSSGWYDYYFGMDV

SEQ ID NO: 22051 - protein, 9 aa, Homo sapiens
  Light chain CDR3 for antibody 11026 (IGKV1-9)
QQGNTYSRT

SEQ ID NO: 22052 - protein, 17 aa, Homo sapiens
  Heavy chain CDR3 for antibody 11026 (IGHV3-33)
ARGDGDILTGYYEWFDH

SEQ ID NO: 22053 - protein, 10 aa, Homo sapiens
  Light chain CDR3 for antibody 11027 (IGKV3-15)
QQYNNWPPYT

SEQ ID NO: 22054 - protein, 15 aa, Homo sapiens
  Heavy chain CDR3 for antibody 11027 (IGHV3-33)
ARDHLTGYYYYGMDV

SEQ ID NO: 22055 - protein, 9 aa, Homo sapiens
  Light chain CDR3 for antibody 11028 (IGKV1-6)
LQDFHYPWT

SEQ ID NO: 22056 - protein, 12 aa, Homo sapiens
  Heavy chain CDR3 for antibody 11028 (IGHV3-33)
ARDGYSSRNFDY

SEQ ID NO: 22057 - protein, 10 aa, Homo sapiens
  Light chain CDR3 for antibody 11029 (IGKV1-6)
QQLDSYPMYT

SEQ ID NO: 22058 - protein, 18 aa, Homo sapiens
  Heavy chain CDR3 for antibody 11029 (IGHV3-48)
ARGLLWFGVSYYYYGMDV

SEQ ID NO: 22059 - protein, 9 aa, Homo sapiens
  Light chain CDR3 for antibody 11030 (IGKV3-11)
QQRSDWPLT

SEQ ID NO: 22060 - protein, 19 aa, Homo sapiens
  Heavy chain CDR3 for antibody 11030 (IGHV5-51)
ARHGEKGKRITMVRGSLDV

SEQ ID NO: 22061 - protein, 8 aa, Homo sapiens
  Light chain CDR3 for antibody 11031 (IGKV1-5)
QQYNSYWT

SEQ ID NO: 22062 - protein, 13 aa, Homo sapiens
  Heavy chain CDR3 for antibody 11031 (IGHV1-24)
ATGYSINWYEFDY

SEQ ID NO: 22063 - protein, 9 aa, Homo sapiens
  Light chain CDR3 for antibody 11032 (IGKV5-2)
LQHDNFPYT

SEQ ID NO: 22064 - protein, 18 aa, Homo sapiens
  Heavy chain CDR3 for antibody 11032 (IGHV3-33)
ARDHYDILTGYYKGWFDP

SEQ ID NO: 22065 - protein, 9 aa, Homo sapiens
  Light chain CDR3 for antibody 11033 (IGKV1-27)
QKYNSAPYT

SEQ ID NO: 22066 - protein, 19 aa, Homo sapiens
  Heavy chain CDR3 for antibody 11033 (IGHV3-33)
ARDNDSSGYYDYYYYGMDV

SEQ ID NO: 22067 - protein, 9 aa, Homo sapiens
  Light chain CDR3 for antibody 11034 (IGKV2-30)
MQGTHWPLT

SEQ ID NO: 22068 - protein, 15 aa, Homo sapiens
  Heavy chain CDR3 for antibody 11034 (IGHV3-20)
AREGSSSWYLYYFDY

SEQ ID NO: 22069 - protein, 9 aa, Homo sapiens
  Light chain CDR3 for antibody 11035 (IGKV1-16)
QHYNDYPFT

SEQ ID NO: 22070 - protein, 16 aa, Homo sapiens
  Heavy chain CDR3 for antibody 11035 (IGHV3-33)
ARDKNTDYDILTGFDY

SEQ ID NO: 22071 - protein, 10 aa, Homo sapiens
  Light chain CDR3 for antibody 11036 (IGKV1-6)
LQDYNYPMYT

SEQ ID NO: 22072 - protein, 13 aa, Homo sapiens
  Heavy chain CDR3 for antibody 11036 (IGHV4-39)
ARQWPSGYWYFDL

SEQ ID NO: 22073 - protein, 9 aa, Homo sapiens
  Light chain CDR3 for antibody 11037 (IGKV1D-16)
LQDYNYMYA

SEQ ID NO: 22074 - protein, 18 aa, Homo sapiens
  Heavy chain CDR3 for antibody 11037 (IGHV1-46)
ARDGDYVWGSYRSNWFDP

SEQ ID NO: 22075 - protein, 9 aa, Homo sapiens
  Light chain CDR3 for antibody 11038 (IGKV1-6)
LQDYKHPFT

SEQ ID NO: 22076 - protein, 15 aa, Homo sapiens
  Heavy chain CDR3 for antibody 11038 (IGHV3-33)
ARGYYYGSGSFPFDY

SEQ ID NO: 22077 - protein, 11 aa, Homo sapiens
  Light chain CDR3 for antibody 11039 (IGKV3-11)
QQRSNWPPTWT

SEQ ID NO: 22078 - protein, 14 aa, Homo sapiens
  Heavy chain CDR3 for antibody 11039 (IGHV3-64)
ARDHAAGGYSHSDY

SEQ ID NO: 22079 - protein, 9 aa, Homo sapiens
  Light chain CDR3 for antibody 11040 (IGKV3D-7)
QQDYEFPIT

SEQ ID NO: 22080 - protein, 23 aa, Homo sapiens
  Heavy chain CDR3 for antibody 11040 (IGHV1-18)
ARNLHYDILTGYFPYYFYYGMDV

SEQ ID NO: 22081 - protein, 9 aa, Homo sapiens
  Light chain CDR3 for antibody 11041 (IGKV1-17)
LHSNNYPWT

SEQ ID NO: 22082 - protein, 10 aa, Homo sapiens
  Heavy chain CDR3 for antibody 11041 (IGHV3-30)
AREWYGGMDV

SEQ ID NO: 22083 - protein, 9 aa, Homo sapiens
  Light chain CDR3 for antibody 11042 (IGKV1-9)
QQLNSYPLT

SEQ ID NO: 22084 - protein, 13 aa, Homo sapiens
  Heavy chain CDR3 for antibody 11042 (IGHV3-30)
ARYSSSWYDACDI

SEQ ID NO: 22085 - protein, 9 aa, Homo sapiens
  Light chain CDR3 for antibody 11043 (IGKV1-9)
QQLNTYPWT

SEQ ID NO: 22086 - protein, 13 aa, Homo sapiens
  Heavy chain CDR3 for antibody 11043 (IGHV3-33)
VSTGDSYYYVMDV

SEQ ID NO: 22087 - protein, 8 aa, Homo sapiens
  Light chain CDR3 for antibody 11044 (IGKV3-20)
QQYGSSLT

SEQ ID NO: 22088 - protein, 18 aa, Homo sapiens
  Heavy chain CDR3 for antibody 11044 (IGHV3-33)
ARREGIVGATTYYYGMDV

SEQ ID NO: 22089 - protein, 9 aa, Homo sapiens
  Light chain CDR3 for antibody 11045 (IGKV1-39)
QQGFSTPWT

SEQ ID NO: 22090 - protein, 12 aa, Homo sapiens
  Heavy chain CDR3 for antibody 11045 (IGHV4-59)
ARDSGSYYYFDY

SEQ ID NO: 22091 - protein, 9 aa, Homo sapiens
  Light chain CDR3 for antibody 11046 (IGKV3-11)
QQRSNWPCT

SEQ ID NO: 22092 - protein, 19 aa, Homo sapiens
  Heavy chain CDR3 for antibody 11046 (IGHV3-33)
ARDSGYSGYDYYYYYGMDV

SEQ ID NO: 22093 - protein, 9 aa, Homo sapiens
  Light chain CDR3 for antibody 11047 (IGKV4-1)
QQYYSTPPT

SEQ ID NO: 22094 - protein, 13 aa, Homo sapiens
  Heavy chain CDR3 for antibody 11047 (IGHV3-66)
ARRATLVRGVFDP

SEQ ID NO: 22095 - protein, 9 aa, Homo sapiens
  Light chain CDR3 for antibody 11048 (IGKV1-27)
QKYNIAPYT

SEQ ID NO: 22096 - protein, 17 aa, Homo sapiens
  Heavy chain CDR3 for antibody 11048 (IGHV1-18)
ARERYYGSGIYKYAMDV

SEQ ID NO: 22097 - protein, 10 aa, Homo sapiens
  Light chain CDR3 for antibody 11049 (IGKV3-15)
QQYNKWPPYT

SEQ ID NO: 22098 - protein, 18 aa, Homo sapiens
  Heavy chain CDR3 for antibody 11049 (IGHV1-8)
AKDRITGTTYGYYSGLDV

SEQ ID NO: 22099 - protein, 9 aa, Homo sapiens
  Light chain CDR3 for antibody 11050 (IGKV1-17)
LHSNNYPWT

SEQ ID NO: 22100 - protein, 13 aa, Homo sapiens
  Heavy chain CDR3 for antibody 11050 (IGHV1-18)
ARAITMVRGVIDY

SEQ ID NO: 22101 - protein, 9 aa, Homo sapiens
  Light chain CDR3 for antibody 11051 (IGKV1-6)
LQDYNYPWT

SEQ ID NO: 22102 - protein, 14 aa, Homo sapiens
  Heavy chain CDR3 for antibody 11051 (IGHV3-33)
ARAYYDILTGYWGY

SEQ ID NO: 22103 - protein, 11 aa, Homo sapiens
  Light chain CDR3 for antibody 11052 (IGKV3D-20)
QQRSSWPPMYP

SEQ ID NO: 22104 - protein, 12 aa, Homo sapiens
  Heavy chain CDR3 for antibody 11052 (IGHV4-61)
ARVYSSGWLFDY

SEQ ID NO: 22105 - protein, 9 aa, Homo sapiens
  Light chain CDR3 for antibody 11053 (IGKV1-16)
QHYNDYPFT

SEQ ID NO: 22106 - protein, 16 aa, Homo sapiens
  Heavy chain CDR3 for antibody 11053 (IGHV3-33)
ARAVYYGSGSSLIMDV

SEQ ID NO: 22107 - protein, 9 aa, Homo sapiens
  Light chain CDR3 for antibody 11054 (IGKV1-9)
QQYNTYSRT

SEQ ID NO: 22108 - protein, 12 aa, Homo sapiens
  Heavy chain CDR3 for antibody 11054 (IGHV3-33)
TRGYSSKSYFDY

SEQ ID NO: 22109 - protein, 8 aa, Homo sapiens
  Light chain CDR3 for antibody 11055 (IGKV3-11)
QQRSNWWT

SEQ ID NO: 22110 - protein, 13 aa, Homo sapiens
  Heavy chain CDR3 for antibody 11055 (IGHV4-61)
ASRYSSGWYPFDY

SEQ ID NO: 22111 - protein, 8 aa, Homo sapiens
  Light chain CDR3 for antibody 11056 (IGKV3-20)
QQYGSSLT

SEQ ID NO: 22112 - protein, 12 aa, Homo sapiens
  Heavy chain CDR3 for antibody 11056 (IGHV3-23)
AKDGWFGESLDY

SEQ ID NO: 22113 - protein, 11 aa, Homo sapiens
  Light chain CDR3 for antibody 11057 (IGKV3-11)
QQRSNWPPTWT

SEQ ID NO: 22114 - protein, 15 aa, Homo sapiens
  Heavy chain CDR3 for antibody 11057 (IGHV3-33)
ARHSSGFYYYYGMDV

SEQ ID NO: 22115 - protein, 9 aa, Homo sapiens
  Light chain CDR3 for antibody 11058 (IGKV3-11)
QQRSNWPPT

SEQ ID NO: 22116 - protein, 14 aa, Homo sapiens
  Heavy chain CDR3 for antibody 11058 (IGHV3-30)
AKDDIVRATGAFDI

SEQ ID NO: 22117 - protein, 9 aa, Homo sapiens
  Light chain CDR3 for antibody 11059 (IGKV1-6)
QQYNSYPLT

SEQ ID NO: 22118 - protein, 15 aa, Homo sapiens
  Heavy chain CDR3 for antibody 11059 (IGHV3-33)
ATERAYGSGSSYCDY

SEQ ID NO: 22119 - protein, 8 aa, Homo sapiens
  Light chain CDR3 for antibody 11060 (IGKV6-21)
HQSSSLPT

SEQ ID NO: 22120 - protein, 11 aa, Homo sapiens
  Heavy chain CDR3 for antibody 11060 (IGHV3-33)
ARARYTTGLDY

SEQ ID NO: 22121 - protein, 9 aa, Homo sapiens
  Light chain CDR3 for antibody 11061 (IGKV1-17)
LQHNSFQLT

SEQ ID NO: 22122 - protein, 15 aa, Homo sapiens
  Heavy chain CDR3 for antibody 11061 (IGHV3-33)
ARDSRPEIIGPPFDY

SEQ ID NO: 22123 - protein, 9 aa, Homo sapiens
  Light chain CDR3 for antibody 11062 (IGKV1-39)
QQSYSTPLT

SEQ ID NO: 22124 - protein, 10 aa, Homo sapiens
  Heavy chain CDR3 for antibody 11062 (IGHV4-39)
ASSNWNDGPL

SEQ ID NO: 22125 - protein, 9 aa, Homo sapiens
  Light chain CDR3 for antibody 11063 (IGKV5-2)
LQHDKFPYT

SEQ ID NO: 22126 - protein, 14 aa, Homo sapiens
  Heavy chain CDR3 for antibody 11063 (IGHV3-20)
ARDEGSTWSDIFDI

SEQ ID NO: 22127 - protein, 9 aa, Homo sapiens
  Light chain CDR3 for antibody 11064 (IGKV2-30)
MQGTHWPLT

SEQ ID NO: 22128 - protein, 13 aa, Homo sapiens
  Heavy chain CDR3 for antibody 11064 (IGHV3-66)
ANTGDSYYYGFYV

SEQ ID NO: 22129 - protein, 9 aa, Homo sapiens
  Light chain CDR3 for antibody 11065 (IGKV1-9)
QQLISYPLT

SEQ ID NO: 22130 - protein, 14 aa, Homo sapiens
  Heavy chain CDR3 for antibody 11065 (IGHV3-33)
ARGAAAGNFYGLDV

SEQ ID NO: 22131 - protein, 9 aa, Homo sapiens
  Light chain CDR3 for antibody 11066 (IGKV3-11)
QQRSNWPPT

SEQ ID NO: 22132 - protein, 9 aa, Homo sapiens
  Heavy chain CDR3 for antibody 11066 (IGHV3-33)
AREYKEFDY

SEQ ID NO: 22133 - protein, 10 aa, Homo sapiens
  Light chain CDR3 for antibody 11067 (IGKV1-27)
QKYNSAPMYT

SEQ ID NO: 22134 - protein, 18 aa, Homo sapiens
  Heavy chain CDR3 for antibody 11067 (IGHV4-39)
ARQYYFGSGNYYRGWFDH

SEQ ID NO: 22135 - protein, 9 aa, Homo sapiens
  Light chain CDR3 for antibody 11068 (IGKV1-17)
LHSNNYPWT

SEQ ID NO: 22136 - protein, 12 aa, Homo sapiens
  Heavy chain CDR3 for antibody 11068 (IGHV3-33)
TRGYSSKSYFDY

SEQ ID NO: 22137 - protein, 9 aa, Homo sapiens
  Light chain CDR3 for antibody 11069 (IGKV1-6)
LQDFHYPPT

SEQ ID NO: 22138 - protein, 12 aa, Homo sapiens
  Heavy chain CDR3 for antibody 11069 (IGHV1-46)
ARGLIGDHAVDI

SEQ ID NO: 22139 - protein, 9 aa, Homo sapiens
  Light chain CDR3 for antibody 11070 (IGKV1D-16)
QQYNSYPFT

SEQ ID NO: 22140 - protein, 18 aa, Homo sapiens
  Heavy chain CDR3 for antibody 11070 (IGHV4-59)
AREMGHDILTGYSDAFEI

SEQ ID NO: 22141 - protein, 9 aa, Homo sapiens
  Light chain CDR3 for antibody 11071 (IGKV1-39)
QQSYSTPYT

SEQ ID NO: 22142 - protein, 14 aa, Homo sapiens
  Heavy chain CDR3 for antibody 11071 (IGHV1-18)
AKCDYDILTGILDY

SEQ ID NO: 22143 - protein, 9 aa, Homo sapiens
  Light chain CDR3 for antibody 11072 (IGKV1D-13)
QHFNNYMYT

SEQ ID NO: 22144 - protein, 17 aa, Homo sapiens
  Heavy chain CDR3 for antibody 11072 (IGHV4-34)
AGLRFFDWLFDYYGMDV

SEQ ID NO: 22145 - protein, 9 aa, Homo sapiens
  Light chain CDR3 for antibody 11073 (IGKV5-2)
LQHDKFPYT

SEQ ID NO: 22146 - protein, 16 aa, Homo sapiens
  Heavy chain CDR3 for antibody 11073 (IGHV3-48)
ARWFSRSSTGVSYMDV

SEQ ID NO: 22147 - protein, 9 aa, Homo sapiens
  Light chain CDR3 for antibody 11074 (IGKV1-9)
QQLNGYPFT

SEQ ID NO: 22148 - protein, 11 aa, Homo sapiens
  Heavy chain CDR3 for antibody 11074 (IGHV1-18)
SRGGFSVGYDS

SEQ ID NO: 22149 - protein, 8 aa, Homo sapiens
  Light chain CDR3 for antibody 11075 (IGKV1D-13)
QQFNNYPT

SEQ ID NO: 22150 - protein, 14 aa, Homo sapiens
  Heavy chain CDR3 for antibody 11075 (IGHV3-33)
VRDQGSMVRGGGDY

SEQ ID NO: 22151 - protein, 8 aa, Homo sapiens
  Light chain CDR3 for antibody 11076 (IGKV1D-13)
QQFNNYPT

SEQ ID NO: 22152 - protein, 11 aa, Homo sapiens
  Heavy chain CDR3 for antibody 11076 (IGHV3-33)
ARAGIAALFDY

SEQ ID NO: 22153 - protein, 10 aa, Homo sapiens
  Light chain CDR3 for antibody 11077 (IGKV3-15)
QQYNNWPPIT

SEQ ID NO: 22154 - protein, 18 aa, Homo sapiens
  Heavy chain CDR3 for antibody 11077 (IGHV3-33)
ARDRGDILTGYYKGWFDP

SEQ ID NO: 22155 - protein, 9 aa, Homo sapiens
  Light chain CDR3 for antibody 11078 (IGKV1-9)
QQLYTYPYT

SEQ ID NO: 22156 - protein, 14 aa, Homo sapiens
  Heavy chain CDR3 for antibody 11078 (IGHV3-33)
ARRGYSGYDWYFDY

SEQ ID NO: 22157 - protein, 9 aa, Homo sapiens
  Light chain CDR3 for antibody 11079 (IGKV1-39)
QQSYRTPLT

SEQ ID NO: 22158 - protein, 12 aa, Homo sapiens
  Heavy chain CDR3 for antibody 11079 (IGHV3-33)
ARKGYDMHAFDI

SEQ ID NO: 22159 - protein, 9 aa, Homo sapiens
  Light chain CDR3 for antibody 11080 (IGKV1-9)
QQLHIYPWT

SEQ ID NO: 22160 - protein, 12 aa, Homo sapiens
  Heavy chain CDR3 for antibody 11080 (IGHV3-33)
ARGYFGSGYAHF

SEQ ID NO: 22161 - protein, 10 aa, Homo sapiens
  Light chain CDR3 for antibody 11081 (IGKV3-11)
QQRSNWPPYT

SEQ ID NO: 22162 - protein, 17 aa, Homo sapiens
  Heavy chain CDR3 for antibody 11081 (IGHV3-33)
ARGDGDILTGYYEWFDP

SEQ ID NO: 22163 - protein, 9 aa, Homo sapiens
  Light chain CDR3 for antibody 11082 (IGKV3-11)
QQRSNWPPT

SEQ ID NO: 22164 - protein, 10 aa, Homo sapiens
  Heavy chain CDR3 for antibody 11082 (IGHV3-33)
AREGLRYFAH

SEQ ID NO: 22165 - protein, 9 aa, Homo sapiens
  Light chain CDR3 for antibody 11083 (IGKV1-33)
QQYDNLPFT

SEQ ID NO: 22166 - protein, 17 aa, Homo sapiens
  Heavy chain CDR3 for antibody 11083 (IGHV3-33)
VREGGLLWVGELSLFDY

SEQ ID NO: 22167 - protein, 10 aa, Homo sapiens
  Light chain CDR3 for antibody 11084 (IGKV3-11)
QQRSNWPILT

SEQ ID NO: 22168 - protein, 13 aa, Homo sapiens
  Heavy chain CDR3 for antibody 11084 (IGHV1-46)
ARRQVGYYYGMDV

SEQ ID NO: 22169 - protein, 9 aa, Homo sapiens
  Light chain CDR3 for antibody 11085 (IGKV3-11)
QQRSSWPPT

SEQ ID NO: 22170 - protein, 14 aa, Homo sapiens
  Heavy chain CDR3 for antibody 11085 (IGHV3-15)
SIYYYGSGRDFFDY

SEQ ID NO: 22171 - protein, 9 aa, Homo sapiens
  Light chain CDR3 for antibody 11086 (IGKV1-27)
QKYNSAPYT

SEQ ID NO: 22172 - protein, 17 aa, Homo sapiens
  Heavy chain CDR3 for antibody 11086 (IGHV1-8)
ARGDYYGSGSPYWYFDL

SEQ ID NO: 22173 - protein, 9 aa, Homo sapiens
  Light chain CDR3 for antibody 11087 (IGKV2-30)
MQGTHWPLT

SEQ ID NO: 22174 - protein, 19 aa, Homo sapiens
  Heavy chain CDR3 for antibody 11087 (IGHV3-30)
ARRFSGYSGYDHYYYGMDV

SEQ ID NO: 22175 - protein, 9 aa, Homo sapiens
  Light chain CDR3 for antibody 11088 (IGKV1-9)
QQLNSYPPL

SEQ ID NO: 22176 - protein, 20 aa, Homo sapiens
  Heavy chain CDR3 for antibody 11088 (IGHV3-30)
ARGGATMIRGLIDYYYGMDV

SEQ ID NO: 22177 - protein, 9 aa, Homo sapiens
  Light chain CDR3 for antibody 11089 (IGKV6-21)
HQSSSLPYT

SEQ ID NO: 22178 - protein, 12 aa, Homo sapiens
  Heavy chain CDR3 for antibody 11089 (IGHV1-46)
ARGLTGDHASAT

SEQ ID NO: 22179 - protein, 9 aa, Homo sapiens
  Light chain CDR3 for antibody 11090 (IGKV6-21)
HQSSSLPLT

SEQ ID NO: 22180 - protein, 11 aa, Homo sapiens
  Heavy chain CDR3 for antibody 11090 (IGHV4-39)
AREFDWSPFDY

SEQ ID NO: 22181 - protein, 9 aa, Homo sapiens
  Light chain CDR3 for antibody 11091 (IGKV1-9)
QQLKSYLYT

SEQ ID NO: 22182 - protein, 14 aa, Homo sapiens
  Heavy chain CDR3 for antibody 11091 (IGHV3-33)
ARDAYDILTGYYDY

SEQ ID NO: 22183 - protein, 9 aa, Homo sapiens
  Light chain CDR3 for antibody 11092 (IGKV3-20)
QQYGSSPYT

SEQ ID NO: 22184 - protein, 10 aa, Homo sapiens
  Heavy chain CDR3 for antibody 11092 (IGHV3-33)
ARKGMNAFDI

SEQ ID NO: 22185 - protein, 9 aa, Homo sapiens
  Light chain CDR3 for antibody 11093 (IGKV1-9)
QQLKSYLYT

SEQ ID NO: 22186 - protein, 18 aa, Homo sapiens
  Heavy chain CDR3 for antibody 11093 (IGHV1-24)
ATGLRYFDWPIISNLFDY

SEQ ID NO: 22187 - protein, 9 aa, Homo sapiens
  Light chain CDR3 for antibody 11094 (IGKV1-39)
QQSYSTPYT

SEQ ID NO: 22188 - protein, 10 aa, Homo sapiens
  Heavy chain CDR3 for antibody 11094 (IGHV3-33)
ARVVDTAMAY

SEQ ID NO: 22189 - protein, 9 aa, Homo sapiens
  Light chain CDR3 for antibody 11095 (IGKV1-17)
LQHNSYPWT

SEQ ID NO: 22190 - protein, 21 aa, Homo sapiens
  Heavy chain CDR3 for antibody 11095 (IGHV3-11)
ARGEALWFGELWGYYYYGMDV

SEQ ID NO: 22191 - protein, 9 aa, Homo sapiens
  Light chain CDR3 for antibody 11096 (IGKV5-2)
LQHDKFPYT

SEQ ID NO: 22192 - protein, 14 aa, Homo sapiens
  Heavy chain CDR3 for antibody 11096 (IGHV3-33)
ARDGVYISSSWFDP

SEQ ID NO: 22193 - protein, 9 aa, Homo sapiens
  Light chain CDR3 for antibody 11097 (IGKV1-9)
QQLNSYPRT

SEQ ID NO: 22194 - protein, 22 aa, Homo sapiens
  Heavy chain CDR3 for antibody 11097 (IGHV3-23)
TKDPGGIVAKIRDYQYFYGVDV

SEQ ID NO: 22195 - protein, 9 aa, Homo sapiens
  Light chain CDR3 for antibody 11098 (IGKV3-11)
QQRSNWPLT

SEQ ID NO: 22196 - protein, 18 aa, Homo sapiens
  Heavy chain CDR3 for antibody 11098 (IGHV1-24)
ATGLRYFDWPIISNLFDY

SEQ ID NO: 22197 - protein, 9 aa, Homo sapiens
  Light chain CDR3 for antibody 11099 (IGKV1-16)
QKYNSAPYT

SEQ ID NO: 22198 - protein, 11 aa, Homo sapiens
  Heavy chain CDR3 for antibody 11099 (IGHV3-33)
ARDRGYSYFDY

SEQ ID NO: 22199 - protein, 9 aa, Homo sapiens
  Light chain CDR3 for antibody 11100 (IGKV2D-28)
MQTLQTPWT

SEQ ID NO: 22200 - protein, 18 aa, Homo sapiens
  Heavy chain CDR3 for antibody 11100 (IGHV6-1)
ARDQYSYGPYYYYYGMDV

SEQ ID NO: 22201 - protein, 9 aa, Homo sapiens
  Light chain CDR3 for antibody 11101 (IGKV3-11)
QQRSNWPPT

SEQ ID NO: 22202 - protein, 14 aa, Homo sapiens
  Heavy chain CDR3 for antibody 11101 (IGHV3-33)
AREGYSSGWDYFDH

SEQ ID NO: 22203 - protein, 9 aa, Homo sapiens
  Light chain CDR3 for antibody 11102 (IGKV1-6)
LQDYKSPFT

SEQ ID NO: 22204 - protein, 17 aa, Homo sapiens
  Heavy chain CDR3 for antibody 11102 (IGHV3-23)
AKDGSFYSSGWYDAFDI

SEQ ID NO: 22205 - protein, 9 aa, Homo sapiens
  Light chain CDR3 for antibody 11103 (IGKV1-17)
LQHNSYPRT

SEQ ID NO: 22206 - protein, 14 aa, Homo sapiens
  Heavy chain CDR3 for antibody 11103 (IGHV1-8)
AREGGSGSSPGMDV

SEQ ID NO: 22207 - protein, 9 aa, Homo sapiens
  Light chain CDR3 for antibody 11104 (IGKV1D-13)
QRFNNYLYT

SEQ ID NO: 22208 - protein, 15 aa, Homo sapiens
  Heavy chain CDR3 for antibody 11104 (IGHV3-33)
VCVLYDYGDYVGFDY

SEQ ID NO: 22209 - protein, 8 aa, Homo sapiens
  Light chain CDR3 for antibody 11105 (IGKV1D-13)
QQFNNYPT

SEQ ID NO: 22210 - protein, 18 aa, Homo sapiens
  Heavy chain CDR3 for antibody 11105 (IGHV3-33)
VREGGYYGSGSYPDAFDI

SEQ ID NO: 22211 - protein, 9 aa, Homo sapiens
  Light chain CDR3 for antibody 11106 (IGKV1-39)
QQSYSTPYT

SEQ ID NO: 22212 - protein, 18 aa, Homo sapiens
  Heavy chain CDR3 for antibody 11106 (IGHV3-23)
AKERGYYGSGSYSNWFDP

SEQ ID NO: 22213 - protein, 8 aa, Homo sapiens
  Light chain CDR3 for antibody 11107 (IGKV3D-7)
QQDYNLLT

SEQ ID NO: 22214 - protein, 14 aa, Homo sapiens
  Heavy chain CDR3 for antibody 11107 (IGHV3-33)
VSAISGSSYWYFAL

SEQ ID NO: 22215 - protein, 9 aa, Homo sapiens
  Light chain CDR3 for antibody 11108 (IGKV1-39)
QQSYSTPLT

SEQ ID NO: 22216 - protein, 22 aa, Homo sapiens
  Heavy chain CDR3 for antibody 11108 (IGHV3-23)
AKDDLPYYDILTHSTTTGGMDV

SEQ ID NO: 22217 - protein, 9 aa, Homo sapiens
  Light chain CDR3 for antibody 11109 (IGKV1-9)
QQLHIYPWT

SEQ ID NO: 22218 - protein, 18 aa, Homo sapiens
  Heavy chain CDR3 for antibody 11109 (IGHV3-33)
ARDGDYVWGSYRSDWFDP

SEQ ID NO: 22219 - protein, 9 aa, Homo sapiens
  Light chain CDR3 for antibody 11110 (IGKV3-15)
QQYHNWPYT

SEQ ID NO: 22220 - protein, 14 aa, Homo sapiens
  Heavy chain CDR3 for antibody 11110 (IGHV3-20)
AREGWFGDYYGMDV

SEQ ID NO: 22221 - protein, 9 aa, Homo sapiens
  Light chain CDR3 for antibody 11111 (IGKV1-39)
QQSYSTPIT

SEQ ID NO: 22222 - protein, 13 aa, Homo sapiens
  Heavy chain CDR3 for antibody 11111 (IGHV4-39)
ARRDGGYYGYFDY

SEQ ID NO: 22223 - protein, 8 aa, Homo sapiens
  Light chain CDR3 for antibody 11112 (IGKV1-5)
QQYNSYYT

SEQ ID NO: 22224 - protein, 13 aa, Homo sapiens
  Heavy chain CDR3 for antibody 11112 (IGHV3-33)
ARDSSSWYHWFDP

SEQ ID NO: 22225 - protein, 10 aa, Homo sapiens
  Light chain CDR3 for antibody 11113 (IGKV3-11)
QQRSNWPIWT

SEQ ID NO: 22226 - protein, 14 aa, Homo sapiens
  Heavy chain CDR3 for antibody 11113 (IGHV3-33)
ARWELPFYYSGMDV

SEQ ID NO: 22227 - protein, 8 aa, Homo sapiens
  Light chain CDR3 for antibody 11114 (IGKV3-20)
QQYGSSFT

SEQ ID NO: 22228 - protein, 11 aa, Homo sapiens
  Heavy chain CDR3 for antibody 11114 (IGHV4-4)
AREAYYYGLDV

SEQ ID NO: 22229 - protein, 10 aa, Homo sapiens
  Light chain CDR3 for antibody 11115 (IGKV3-15)
QQYNNWPPYT

SEQ ID NO: 22230 - protein, 12 aa, Homo sapiens
  Heavy chain CDR3 for antibody 11115 (IGHV3-33)
ARDLVGATPFDY

SEQ ID NO: 22231 - protein, 9 aa, Homo sapiens
  Light chain CDR3 for antibody 11116 (IGKV1D-16)
QQYNSYPLT

SEQ ID NO: 22232 - protein, 6 aa, Homo sapiens
  Heavy chain CDR3 for antibody 11116 (IGHV3-33)
ARTTAA

SEQ ID NO: 22233 - protein, 9 aa, Homo sapiens
  Light chain CDR3 for antibody 11117 (IGKV3-11)
QQRINWPWT

SEQ ID NO: 22234 - protein, 15 aa, Homo sapiens
  Heavy chain CDR3 for antibody 11117 (IGHV4-59)
ARDIGYYGSGSPLDY

SEQ ID NO: 22235 - protein, 9 aa, Homo sapiens
  Light chain CDR3 for antibody 11118 (IGKV1-33)
QQYDNLPFT

SEQ ID NO: 22236 - protein, 17 aa, Homo sapiens
  Heavy chain CDR3 for antibody 11118 (IGHV3-30)
ARDGVGATSYYYYGMDV

SEQ ID NO: 22237 - protein, 9 aa, Homo sapiens
  Light chain CDR3 for antibody 11119 (IGKV1-6)
LQDYHYPWT

SEQ ID NO: 22238 - protein, 23 aa, Homo sapiens
  Heavy chain CDR3 for antibody 11119 (IGHV3-11)
ARDEGVTMLRGVISYYYYYGMDV

SEQ ID NO: 22239 - protein, 9 aa, Homo sapiens
  Light chain CDR3 for antibody 11120 (IGKV1-6)
LQDYKSPFT

SEQ ID NO: 22240 - protein, 14 aa, Homo sapiens
  Heavy chain CDR3 for antibody 11120 (IGHV3-33)
AREGYSSNWYDFDY

SEQ ID NO: 22241 - protein, 8 aa, Homo sapiens
  Light chain CDR3 for antibody 11121 (IGKV6-21)
HQSSSLPT

SEQ ID NO: 22242 - protein, 17 aa, Homo sapiens
  Heavy chain CDR3 for antibody 11121 (IGHV3-23)
AKEYCSGGSCYVYYFDY

SEQ ID NO: 22243 - protein, 9 aa, Homo sapiens
  Light chain CDR3 for antibody 11122 (IGKV2-30)
MQGTHWPLT

SEQ ID NO: 22244 - protein, 11 aa, Homo sapiens
  Heavy chain CDR3 for antibody 11122 (IGHV4-59)
TRDRGLGSFDY

SEQ ID NO: 22245 - protein, 9 aa, Homo sapiens
  Light chain CDR3 for antibody 11123 (IGKV1D-16)
QQYNSYPYT

SEQ ID NO: 22246 - protein, 19 aa, Homo sapiens
  Heavy chain CDR3 for antibody 11123 (IGHV5-51)
ARHGEKGKRTTMVRGSPDV

SEQ ID NO: 22247 - protein, 9 aa, Homo sapiens
  Light chain CDR3 for antibody 11124 (IGKV1-17)
LHSNNYPWT

SEQ ID NO: 22248 - protein, 10 aa, Homo sapiens
  Heavy chain CDR3 for antibody 11124 (IGHV3-33)
ARENSTPLDY

SEQ ID NO: 22249 - protein, 9 aa, Homo sapiens
  Light chain CDR3 for antibody 11125 (IGKV1-9)
QQGNTYSRT

SEQ ID NO: 22250 - protein, 13 aa, Homo sapiens
  Heavy chain CDR3 for antibody 11125 (IGHV3-33)
ARAFIMVRGVIDY

SEQ ID NO: 22251 - protein, 9 aa, Homo sapiens
  Light chain CDR3 for antibody 11126 (IGKV1D-13)
QRFNNYLYT

SEQ ID NO: 22252 - protein, 12 aa, Homo sapiens
  Heavy chain CDR3 for antibody 11126 (IGHV3-33)
ARVDAAAPYFDY

SEQ ID NO: 22253 - protein, 9 aa, Homo sapiens
  Light chain CDR3 for antibody 11127 (IGKV1-27)
QKYNSAPYT

SEQ ID NO: 22254 - protein, 13 aa, Homo sapiens
  Heavy chain CDR3 for antibody 11127 (IGHV4-39)
ARRDVLAPAAFDY

SEQ ID NO: 22255 - protein, 9 aa, Homo sapiens
  Light chain CDR3 for antibody 11128 (IGKV1-39)
QQGYRTPLT

SEQ ID NO: 22256 - protein, 17 aa, Homo sapiens
  Heavy chain CDR3 for antibody 11128 (IGHV4-34)
AGLRFFDWLFDYYGMDV

SEQ ID NO: 22257 - protein, 8 aa, Homo sapiens
  Light chain CDR3 for antibody 11129 (IGKV1D-13)
QQFNNYPT

SEQ ID NO: 22258 - protein, 19 aa, Homo sapiens
  Heavy chain CDR3 for antibody 11129 (IGHV3-33)
ARDRYYDILTGYYKGWFDP

SEQ ID NO: 22259 - protein, 9 aa, Homo sapiens
  Light chain CDR3 for antibody 11130 (IGKV1-6)
LQDYNSPWT

SEQ ID NO: 22260 - protein, 14 aa, Homo sapiens
  Heavy chain CDR3 for antibody 11130 (IGHV3-23)
AKSRIVGALYYFGY

SEQ ID NO: 22261 - protein, 9 aa, Homo sapiens
  Light chain CDR3 for antibody 11131 (IGKV6-21)
HQSSSLPYT

SEQ ID NO: 22262 - protein, 16 aa, Homo sapiens
  Heavy chain CDR3 for antibody 11131 (IGHV3-23)
AKEGMVLRYIDGFWDY

SEQ ID NO: 22263 - protein, 9 aa, Homo sapiens
  Light chain CDR3 for antibody 11132 (IGKV1-9)
QQGNTYSRT

SEQ ID NO: 22264 - protein, 22 aa, Homo sapiens
  Heavy chain CDR3 for antibody 11132 (IGHV4-59)
AREINYGSGSYYNEDYYYGMDV

SEQ ID NO: 22265 - protein, 9 aa, Homo sapiens
  Light chain CDR3 for antibody 11133 (IGKV1-39)
QQSHSTPYT

SEQ ID NO: 22266 - protein, 13 aa, Homo sapiens
  Heavy chain CDR3 for antibody 11133 (IGHV4-39)
ARVPLTDFYYFDY

SEQ ID NO: 22267 - protein, 9 aa, Homo sapiens
  Light chain CDR3 for antibody 11134 (IGKV1-39)
QQSYSTPYA

SEQ ID NO: 22268 - protein, 16 aa, Homo sapiens
  Heavy chain CDR3 for antibody 11134 (IGHV1-24)
ATEDSSSTYYYYGLDV

SEQ ID NO: 22269 - protein, 10 aa, Homo sapiens
  Light chain CDR3 for antibody 11135 (IGKV1-39)
QQSYSSPMYT

SEQ ID NO: 22270 - protein, 14 aa, Homo sapiens
  Heavy chain CDR3 for antibody 11135 (IGHV3-33)
ARKGYSGRYYYFDY

SEQ ID NO: 22271 - protein, 9 aa, Homo sapiens
  Light chain CDR3 for antibody 11136 (IGKV1D-16)
QQYNSYPYT

SEQ ID NO: 22272 - protein, 16 aa, Homo sapiens
  Heavy chain CDR3 for antibody 11136 (IGHV3-15)
AADLGDHADAYATLDN

SEQ ID NO: 22273 - protein, 9 aa, Homo sapiens
  Light chain CDR3 for antibody 11137 (IGKV1D-16)
QQYNSYPYT

SEQ ID NO: 22274 - protein, 9 aa, Homo sapiens
  Heavy chain CDR3 for antibody 11137 (IGHV4-34)
ARDLYYFDY

SEQ ID NO: 22275 - protein, 9 aa, Homo sapiens
  Light chain CDR3 for antibody 11138 (IGKV1-39)
QQSYSTPYT

SEQ ID NO: 22276 - protein, 15 aa, Homo sapiens
  Heavy chain CDR3 for antibody 11138 (IGHV1-18)
ARSITMVRGVPPFDY

SEQ ID NO: 22277 - protein, 9 aa, Homo sapiens
  Light chain CDR3 for antibody 11139 (IGKV1-6)
LQDYNYPYT

SEQ ID NO: 22278 - protein, 16 aa, Homo sapiens
  Heavy chain CDR3 for antibody 11139 (IGHV3-33)
ARGYFGSGSSSRWVDP

SEQ ID NO: 22279 - protein, 9 aa, Homo sapiens
  Light chain CDR3 for antibody 11140 (IGKV3D-15)
QQYNNWPIT

SEQ ID NO: 22280 - protein, 16 aa, Homo sapiens
  Heavy chain CDR3 for antibody 11140 (IGHV3-33)
ARGDDILTHQYYGVDV

SEQ ID NO: 22281 - protein, 9 aa, Homo sapiens
  Light chain CDR3 for antibody 11141 (IGKV1-37)
QRTYNAPFT

SEQ ID NO: 22282 - protein, 18 aa, Homo sapiens
  Heavy chain CDR3 for antibody 11141 (IGHV3-33)
ARAYYDILTGYYRTGMDV

SEQ ID NO: 22283 - protein, 9 aa, Homo sapiens
  Light chain CDR3 for antibody 11142 (IGKV3-11)
QQRSNWMYT

SEQ ID NO: 22284 - protein, 15 aa, Homo sapiens
  Heavy chain CDR3 for antibody 11142 (IGHV3-33)
ARRICSGGSCSLLDY

SEQ ID NO: 22285 - protein, 7 aa, Homo sapiens
  Light chain CDR3 for antibody 11143 (IGKV1-17)
LQHNSYP

SEQ ID NO: 22286 - protein, 17 aa, Homo sapiens
  Heavy chain CDR3 for antibody 11143 (IGHV4-59)
ARDFLVRGEGSYYGMDV

SEQ ID NO: 22287 - protein, 7 aa, Homo sapiens
  Light chain CDR3 for antibody 11144 (IGKV3-11)
QQRSKFT

SEQ ID NO: 22288 - protein, 18 aa, Homo sapiens
  Heavy chain CDR3 for antibody 11144 (IGHV1-18)
ARDRYYYDSGSYYYGMDV

SEQ ID NO: 22289 - protein, 9 aa, Homo sapiens
  Light chain CDR3 for antibody 11145 (IGKV3-11)
QQRSNWPPT

SEQ ID NO: 22290 - protein, 16 aa, Homo sapiens
  Heavy chain CDR3 for antibody 11145 (IGHV3-33)
ARGGLTGGGDYDAFDI

SEQ ID NO: 22291 - protein, 10 aa, Homo sapiens
  Light chain CDR3 for antibody 11146 (IGKV1-17)
LQHNSYPMYT

SEQ ID NO: 22292 - protein, 18 aa, Homo sapiens
  Heavy chain CDR3 for antibody 11146 (IGHV3-33)
AREGSYYGSGSFPNWFDP

SEQ ID NO: 22293 - protein, 9 aa, Homo sapiens
  Light chain CDR3 for antibody 11147 (IGKV5-2)
LQHDKFPYT

SEQ ID NO: 22294 - protein, 14 aa, Homo sapiens
  Heavy chain CDR3 for antibody 11147 (IGHV3-20)
ARDRGSSGHDAFDI

SEQ ID NO: 22295 - protein, 9 aa, Homo sapiens
  Light chain CDR3 for antibody 11148 (IGKV1-17)
LQHTSYPFT

SEQ ID NO: 22296 - protein, 17 aa, Homo sapiens
  Heavy chain CDR3 for antibody 11148 (IGHV1-2)
ARDEGYDILTGYPHFDY

SEQ ID NO: 22297 - protein, 9 aa, Homo sapiens
  Light chain CDR3 for antibody 11149 (IGKV1-9)
QQFNSYTRT

SEQ ID NO: 22298 - protein, 16 aa, Homo sapiens
  Heavy chain CDR3 for antibody 11149 (IGHV3-23)
AKEGMVLRYFDWLWDY

SEQ ID NO: 22299 - protein, 9 aa, Homo sapiens
  Light chain CDR3 for antibody 11150 (IGKV3-11)
QQRSNWPWT

SEQ ID NO: 22300 - protein, 14 aa, Homo sapiens
  Heavy chain CDR3 for antibody 11150 (IGHV3-33)
ARDAMGTPTAWFDP

SEQ ID NO: 22301 - protein, 10 aa, Homo sapiens
  Light chain CDR3 for antibody 11151 (IGKV3-11)
QQRSTWPTLI

SEQ ID NO: 22302 - protein, 13 aa, Homo sapiens
  Heavy chain CDR3 for antibody 11151 (IGHV3-23)
ASPFNWNDGFFDY

SEQ ID NO: 22303 - protein, 9 aa, Homo sapiens
  Light chain CDR3 for antibody 11152 (IGKV1-9)
QQYNTYSRT

SEQ ID NO: 22304 - protein, 20 aa, Homo sapiens
  Heavy chain CDR3 for antibody 11152 (IGHV3-23)
AKDREMAATSHYYYYYGMDV

SEQ ID NO: 22305 - protein, 9 aa, Homo sapiens
  Light chain CDR3 for antibody 11153 (IGKV1-16)
QHYNDYPFT

SEQ ID NO: 22306 - protein, 18 aa, Homo sapiens
  Heavy chain CDR3 for antibody 11153 (IGHV3-30)
ARDRHHDILTGYSDAFEI

SEQ ID NO: 22307 - protein, 11 aa, Homo sapiens
  Light chain CDR3 for antibody 11154 (IGKV3-11)
QQRSNWPPMYT

SEQ ID NO: 22308 - protein, 15 aa, Homo sapiens
  Heavy chain CDR3 for antibody 11154 (IGHV4-39)
ARDTGYSSSWNWFDP

SEQ ID NO: 22309 - protein, 8 aa, Homo sapiens
  Light chain CDR3 for antibody 11155 (IGKV6-21)
HQSSSLPT

SEQ ID NO: 22310 - protein, 16 aa, Homo sapiens
  Heavy chain CDR3 for antibody 11155 (IGHV1-8)
AREGTMVRGVTYAFDI

SEQ ID NO: 22311 - protein, 9 aa, Homo sapiens
  Light chain CDR3 for antibody 11156 (IGKV5-2)
LQRDKFPYT

SEQ ID NO: 22312 - protein, 20 aa, Homo sapiens
  Heavy chain CDR3 for antibody 11156 (IGHV3-33)
AREDYYGSGSYYPAYNWFDP

SEQ ID NO: 22313 - protein, 9 aa, Homo sapiens
  Light chain CDR3 for antibody 11157 (IGKV1-17)
QQYNSYPYT

SEQ ID NO: 22314 - protein, 17 aa, Homo sapiens
  Heavy chain CDR3 for antibody 11157 (IGHV4-59)
ARRTTMVREIIVTHFDY

SEQ ID NO: 22315 - protein, 9 aa, Homo sapiens
  Light chain CDR3 for antibody 11158 (IGKV6-21)
HQSSSLPYT

SEQ ID NO: 22316 - protein, 16 aa, Homo sapiens
  Heavy chain CDR3 for antibody 11158 (IGHV4-59)
AREGYNWNDGVNWFDP

SEQ ID NO: 22317 - protein, 9 aa, Homo sapiens
  Light chain CDR3 for antibody 11159 (IGKV1-33)
QQYDNLPFT

SEQ ID NO: 22318 - protein, 9 aa, Homo sapiens
  Heavy chain CDR3 for antibody 11159 (IGHV4-59)
ARGGASFDY

SEQ ID NO: 22319 - protein, 9 aa, Homo sapiens
  Light chain CDR3 for antibody 11160 (IGKV1-17)
QQLKSYLYT

SEQ ID NO: 22320 - protein, 13 aa, Homo sapiens
  Heavy chain CDR3 for antibody 11160 (IGHV4-59)
ARTMVRGVAPFDY

SEQ ID NO: 22321 - protein, 9 aa, Homo sapiens
  Light chain CDR3 for antibody 11161 (IGKV1D-13)
QQFNNYPHT

SEQ ID NO: 22322 - protein, 13 aa, Homo sapiens
  Heavy chain CDR3 for antibody 11161 (IGHV3-23)
AKERLRYFDWLAY

SEQ ID NO: 22323 - protein, 9 aa, Homo sapiens
  Light chain CDR3 for antibody 11162 (IGKV3D-7)
QQDYTLPLT

SEQ ID NO: 22324 - protein, 15 aa, Homo sapiens
  Heavy chain CDR3 for antibody 11162 (IGHV3-23)
AKDGFYYGSGSSFDH

SEQ ID NO: 22325 - protein, 10 aa, Homo sapiens
  Light chain CDR3 for antibody 11163 (IGKV3-11)
QQRSNWPIFT

SEQ ID NO: 22326 - protein, 12 aa, Homo sapiens
  Heavy chain CDR3 for antibody 11163 (IGHV4-39)
ARREVILGAFDY

SEQ ID NO: 22327 - protein, 9 aa, Homo sapiens
  Light chain CDR3 for antibody 11164 (IGKV1D-13)
QHFNNYMYT

SEQ ID NO: 22328 - protein, 18 aa, Homo sapiens
  Heavy chain CDR3 for antibody 11164 (IGHV4-39)
ARQYYFGSGNYYRGWFDP

SEQ ID NO: 22329 - protein, 9 aa, Homo sapiens
  Light chain CDR3 for antibody 11165 (IGKV6-21)
HQSISLPHT

SEQ ID NO: 22330 - protein, 12 aa, Homo sapiens
  Heavy chain CDR3 for antibody 11165 (IGHV3-33)
TRGYSSKSYFDC

SEQ ID NO: 22331 - protein, 9 aa, Homo sapiens
  Light chain CDR3 for antibody 11166 (IGKV2-30)
MQGTHWPLT

SEQ ID NO: 22332 - protein, 14 aa, Homo sapiens
  Heavy chain CDR3 for antibody 11166 (IGHV4-59)
AKGGSGSYYNWFDP

SEQ ID NO: 22333 - protein, 9 aa, Homo sapiens
  Light chain CDR3 for antibody 11167 (IGKV1D-16)
QQYNSYPYT

SEQ ID NO: 22334 - protein, 12 aa, Homo sapiens
  Heavy chain CDR3 for antibody 11167 (IGHV3-33)
AREGVMGYSGSY

SEQ ID NO: 22335 - protein, 8 aa, Homo sapiens
  Light chain CDR3 for antibody 11168 (IGKV6-21)
HQSSSLPT

SEQ ID NO: 22336 - protein, 13 aa, Homo sapiens
  Heavy chain CDR3 for antibody 11168 (IGHV4-39)
ARREVVGGRGFDY

SEQ ID NO: 22337 - protein, 9 aa, Homo sapiens
  Light chain CDR3 for antibody 11169 (IGKV5-2)
LQHDNFPYT

SEQ ID NO: 22338 - protein, 12 aa, Homo sapiens
  Heavy chain CDR3 for antibody 11169 (IGHV3-11)
VRVLLWFGESDY

SEQ ID NO: 22339 - protein, 9 aa, Homo sapiens
  Light chain CDR3 for antibody 11170 (IGKV1-17)
LQDFHYPWT

SEQ ID NO: 22340 - protein, 8 aa, Homo sapiens
  Heavy chain CDR3 for antibody 11170 (IGHV3-23)
AKETGNNY

SEQ ID NO: 22341 - protein, 9 aa, Homo sapiens
  Light chain CDR3 for antibody 11171 (IGKV3D-7)
QQDYEFPLT

SEQ ID NO: 22342 - protein, 20 aa, Homo sapiens
  Heavy chain CDR3 for antibody 11171 (IGHV3-33)
ARDPAQLERRYYYFYYGMDV

SEQ ID NO: 22343 - protein, 8 aa, Homo sapiens
  Light chain CDR3 for antibody 11172 (IGKV1-13)
QQFNTYYT

SEQ ID NO: 22344 - protein, 24 aa, Homo sapiens
  Heavy chain CDR3 for antibody 11172 (IGHV3-20)
ARGRITMVRGVIINPLDYYNGMDV

SEQ ID NO: 22345 - protein, 9 aa, Homo sapiens
  Light chain CDR3 for antibody 11173 (IGKV5-2)
LQHDKFPYT

SEQ ID NO: 22346 - protein, 7 aa, Homo sapiens
  Heavy chain CDR3 for antibody 11173 (IGHV3-33)
ARELFDS

SEQ ID NO: 22347 - protein, 9 aa, Homo sapiens
  Light chain CDR3 for antibody 11174 (IGKV1-9)
QQLNNYLFT

SEQ ID NO: 22348 - protein, 13 aa, Homo sapiens
  Heavy chain CDR3 for antibody 11174 (IGHV3-33)
ARSGSYWGYYFDY

SEQ ID NO: 22349 - protein, 9 aa, Homo sapiens
  Light chain CDR3 for antibody 11175 (IGKV1-9)
QQLHSYPYT

SEQ ID NO: 22350 - protein, 18 aa, Homo sapiens
  Heavy chain CDR3 for antibody 11175 (IGHV3-33)
AREGYDILTGYYTVKFDY

SEQ ID NO: 22351 - protein, 9 aa, Homo sapiens
  Light chain CDR3 for antibody 11176 (IGKV3D-7)
QQDYEFALT

SEQ ID NO: 22352 - protein, 12 aa, Homo sapiens
  Heavy chain CDR3 for antibody 11176 (IGHV3-13)
ARDRGYSGYFDY

SEQ ID NO: 22353 - protein, 9 aa, Homo sapiens
  Light chain CDR3 for antibody 11177 (IGKV1D-16)
QQYITYPYT

SEQ ID NO: 22354 - protein, 13 aa, Homo sapiens
  Heavy chain CDR3 for antibody 11177 (IGHV3-64)
ARERYYGSGYAHF

SEQ ID NO: 22355 - protein, 9 aa, Homo sapiens
  Light chain CDR3 for antibody 11178 (IGKV1-17)
LQQNSYPWT

SEQ ID NO: 22356 - protein, 11 aa, Homo sapiens
  Heavy chain CDR3 for antibody 11178 (IGHV3-33)
ARLSGEGHFDS

SEQ ID NO: 22357 - protein, 9 aa, Homo sapiens
  Light chain CDR3 for antibody 11179 (IGKV3D-7)
QQDYKLPLT

SEQ ID NO: 22358 - protein, 15 aa, Homo sapiens
  Heavy chain CDR3 for antibody 11179 (IGHV3-33)
ARHSSGFYYYYGMDV

SEQ ID NO: 22359 - protein, 9 aa, Homo sapiens
  Light chain CDR3 for antibody 11180 (IGKV3D-20)
QQHGNSPLT

SEQ ID NO: 22360 - protein, 18 aa, Homo sapiens
  Heavy chain CDR3 for antibody 11180 (IGHV4-59)
AREGHYYTSGSYYKAFDY

SEQ ID NO: 22361 - protein, 9 aa, Homo sapiens
  Light chain CDR3 for antibody 11181 (IGKV1-9)
QQLNNYLFT

SEQ ID NO: 22362 - protein, 18 aa, Homo sapiens
  Heavy chain CDR3 for antibody 11181 (IGHV4-59)
AREGHYYTSGSYYKAFDY

SEQ ID NO: 22363 - protein, 9 aa, Homo sapiens
  Light chain CDR3 for antibody 11182 (IGKV1D-16)
QQYHSYPYT

SEQ ID NO: 22364 - protein, 17 aa, Homo sapiens
  Heavy chain CDR3 for antibody 11182 (IGHV4-34)
VRDGSGSYTHYYYGMDV

SEQ ID NO: 22365 - protein, 9 aa, Homo sapiens
  Light chain CDR3 for antibody 11183 (IGKV1-16)
QHYNDYPFT

SEQ ID NO: 22366 - protein, 12 aa, Homo sapiens
  Heavy chain CDR3 for antibody 11183 (IGHV3-33)
AREGTRWVYFDY

SEQ ID NO: 22367 - protein, 9 aa, Homo sapiens
  Light chain CDR3 for antibody 11184 (IGKV1D-16)
QQYHSYPYT

SEQ ID NO: 22368 - protein, 10 aa, Homo sapiens
  Heavy chain CDR3 for antibody 11184 (IGHV3-23)
ATIVGPFLDV

SEQ ID NO: 22369 - protein, 9 aa, Homo sapiens
  Light chain CDR3 for antibody 11185 (IGKV3-20)
QQCYSSPFT

SEQ ID NO: 22370 - protein, 18 aa, Homo sapiens
  Heavy chain CDR3 for antibody 11185 (IGHV1-46)
ARDGDYVWGSYRSDWFDP

SEQ ID NO: 22371 - protein, 10 aa, Homo sapiens
  Light chain CDR3 for antibody 11186 (IGKV3-15)
QQYNNWPPIT

SEQ ID NO: 22372 - protein, 12 aa, Homo sapiens
  Heavy chain CDR3 for antibody 11186 (IGHV3-33)
ARDPGYYYGLDV

SEQ ID NO: 22373 - protein, 9 aa, Homo sapiens
  Light chain CDR3 for antibody 11187 (IGKV3-20)
QQYSSSPIT

SEQ ID NO: 22374 - protein, 16 aa, Homo sapiens
  Heavy chain CDR3 for antibody 11187 (IGHV4-59)
ARQLLWFGELKGVFDY

SEQ ID NO: 22375 - protein, 9 aa, Homo sapiens
  Light chain CDR3 for antibody 11188 (IGKV5-2)
LQHDNFPYT

SEQ ID NO: 22376 - protein, 14 aa, Homo sapiens
  Heavy chain CDR3 for antibody 11188 (IGHV3-33)
ARDAMGTSTAWFDP

SEQ ID NO: 22377 - protein, 8 aa, Homo sapiens
  Light chain CDR3 for antibody 11189 (IGKV3D-7)
QQDYNLLT

SEQ ID NO: 22378 - protein, 19 aa, Homo sapiens
  Heavy chain CDR3 for antibody 11189 (IGHV3-33)
ARGGVVRGVIEYYYYGMDV

SEQ ID NO: 22379 - protein, 9 aa, Homo sapiens
  Light chain CDR3 for antibody 11190 (IGKV1-9)
QQLNGYPFT

SEQ ID NO: 22380 - protein, 11 aa, Homo sapiens
  Heavy chain CDR3 for antibody 11190 (IGHV3-23)
AKEGTYFDIPH

SEQ ID NO: 22381 - protein, 9 aa, Homo sapiens
  Light chain CDR3 for antibody 11191 (IGKV1-17)
QQYHSYPYT

SEQ ID NO: 22382 - protein, 11 aa, Homo sapiens
  Heavy chain CDR3 for antibody 11191 (IGHV3-33)
ARDRSSGPFDH

SEQ ID NO: 22383 - protein, 9 aa, Homo sapiens
  Light chain CDR3 for antibody 11192 (IGKV3-11)
QQRSDWPLT

SEQ ID NO: 22384 - protein, 12 aa, Homo sapiens
  Heavy chain CDR3 for antibody 11192 (IGHV3-33)
TRGYSSKSYFDY

SEQ ID NO: 22385 - protein, 10 aa, Homo sapiens
  Light chain CDR3 for antibody 11193 (IGKV3-20)
QQYGRSPPVT

SEQ ID NO: 22386 - protein, 17 aa, Homo sapiens
  Heavy chain CDR3 for antibody 11193 (IGHV3-23)
AKDYDILTGYSHNWFDP

SEQ ID NO: 22387 - protein, 9 aa, Homo sapiens
  Light chain CDR3 for antibody 11194 (IGKV1-6)
QQFNNYMYT

SEQ ID NO: 22388 - protein, 13 aa, Homo sapiens
  Heavy chain CDR3 for antibody 11194 (IGHV3-33)
ARDQRYSSGWYDY

SEQ ID NO: 22389 - protein, 9 aa, Homo sapiens
  Light chain CDR3 for antibody 11195 (IGKV1-9)
QQLKSYLYT

SEQ ID NO: 22390 - protein, 14 aa, Homo sapiens
  Heavy chain CDR3 for antibody 11195 (IGHV3-33)
ARDRIAAASSDFDC

SEQ ID NO: 22391 - protein, 8 aa, Homo sapiens
  Light chain CDR3 for antibody 11196 (IGKV1D-13)
QQFNNYPT

SEQ ID NO: 22392 - protein, 12 aa, Homo sapiens
  Heavy chain CDR3 for antibody 11196 (IGHV3-33)
ARKAYALYVLDV

SEQ ID NO: 22393 - protein, 10 aa, Homo sapiens
  Light chain CDR3 for antibody 11197 (IGKV3-11)
QQRSNWLMYT

SEQ ID NO: 22394 - protein, 21 aa, Homo sapiens
  Heavy chain CDR3 for antibody 11197 (IGHV3-23)
AKDIDYYGSGSYPLYYYGMDV

SEQ ID NO: 22395 - protein, 9 aa, Homo sapiens
  Light chain CDR3 for antibody 11198 (IGKV5-2)
LQHDNFPWT

SEQ ID NO: 22396 - protein, 16 aa, Homo sapiens
  Heavy chain CDR3 for antibody 11198 (IGHV1-46)
ARGGGYSGSYSNWFDP

SEQ ID NO: 22397 - protein, 9 aa, Homo sapiens
  Light chain CDR3 for antibody 11199 (IGKV1-9)
QQLNRYPYT

SEQ ID NO: 22398 - protein, 23 aa, Homo sapiens
  Heavy chain CDR3 for antibody 11199 (IGHV3-11)
ARDEGVTMVRGVISYYYYYGMDV

SEQ ID NO: 22399 - protein, 9 aa, Homo sapiens
  Light chain CDR3 for antibody 11200 (IGKV1-9)
QQLNSYPNT

SEQ ID NO: 22400 - protein, 13 aa, Homo sapiens
  Heavy chain CDR3 for antibody 11200 (IGHV4-39)
ARRGVLAPAAFDH

SEQ ID NO: 22401 - protein, 9 aa, Homo sapiens
  Light chain CDR3 for antibody 11201 (IGKV1-6)
LQDYNYPYT

SEQ ID NO: 22402 - protein, 12 aa, Homo sapiens
  Heavy chain CDR3 for antibody 11201 (IGHV1-46)
TFSRSGGGCVDY

SEQ ID NO: 22403 - protein, 11 aa, Homo sapiens
  Light chain CDR3 for antibody 11202 (IGKV3-11)
QQRSNWPPTWT

SEQ ID NO: 22404 - protein, 15 aa, Homo sapiens
  Heavy chain CDR3 for antibody 11202 (IGHV3-23)
AKDGSYYDYYYGMDV

SEQ ID NO: 22405 - protein, 9 aa, Homo sapiens
  Light chain CDR3 for antibody 11203 (IGKV1-39)
QQGFSTPWT

SEQ ID NO: 22406 - protein, 14 aa, Homo sapiens
  Heavy chain CDR3 for antibody 11203 (IGHV4-39)
ARRGVLVPPGGMDV

SEQ ID NO: 22407 - protein, 9 aa, Homo sapiens
  Light chain CDR3 for antibody 11204 (IGKV1-6)
LQDYNYPLT

SEQ ID NO: 22408 - protein, 14 aa, Homo sapiens
  Heavy chain CDR3 for antibody 11204 (IGHV3-33)
ARDRGDILTGYLDY

SEQ ID NO: 22409 - protein, 8 aa, Homo sapiens
  Light chain CDR3 for antibody 11205 (IGKV3-20)
QQYGSSLT

SEQ ID NO: 22410 - protein, 14 aa, Homo sapiens
  Heavy chain CDR3 for antibody 11205 (IGHV1-46)
ARDGVGAKEGGFDY

SEQ ID NO: 22411 - protein, 10 aa, Homo sapiens
  Light chain CDR3 for antibody 11206 (IGKV3-20)
QQYGSSPPYT

SEQ ID NO: 22412 - protein, 19 aa, Homo sapiens
  Heavy chain CDR3 for antibody 11206 (IGHV3-21)
ARGRGSYYYGPGSHYGMDV

SEQ ID NO: 22413 - protein, 9 aa, Homo sapiens
  Light chain CDR3 for antibody 11207 (IGKV1-27)
QKYNSAPYT

SEQ ID NO: 22414 - protein, 9 aa, Homo sapiens
  Heavy chain CDR3 for antibody 11207 (IGHV3-30)
ARGRVSLDV

SEQ ID NO: 22415 - protein, 10 aa, Homo sapiens
  Light chain CDR3 for antibody 11208 (IGKV1-39)
QQSYSTPMYT

SEQ ID NO: 22416 - protein, 11 aa, Homo sapiens
  Heavy chain CDR3 for antibody 11208 (IGHV3-33)
ARGSGSYAFDS

SEQ ID NO: 22417 - protein, 11 aa, Homo sapiens
  Light chain CDR3 for antibody 11209 (IGKV3-11)
QQRSNWPPTWT

SEQ ID NO: 22418 - protein, 24 aa, Homo sapiens
  Heavy chain CDR3 for antibody 11209 (IGHV1-46)
ARDEARGLLTGYYNMREYYYGMDV

SEQ ID NO: 22419 - protein, 9 aa, Homo sapiens
  Light chain CDR3 for antibody 11210 (IGKV1-39)
QQSYSTPLT

SEQ ID NO: 22420 - protein, 11 aa, Homo sapiens
  Heavy chain CDR3 for antibody 11210 (IGHV3-23)
ATREYSSSCDY

SEQ ID NO: 22421 - protein, 8 aa, Homo sapiens
  Light chain CDR3 for antibody 11211 (IGKV1-5)
QQYNSYYT

SEQ ID NO: 22422 - protein, 19 aa, Homo sapiens
  Heavy chain CDR3 for antibody 11211 (IGHV3-33)
ARGVRLRYFEPYYYYGMDV

SEQ ID NO: 22423 - protein, 9 aa, Homo sapiens
  Light chain CDR3 for antibody 11212 (IGKV3-20)
QQYGSSPRT

SEQ ID NO: 22424 - protein, 16 aa, Homo sapiens
  Heavy chain CDR3 for antibody 11212 (IGHV1-24)
ATEESSSYYYYYAMDI

SEQ ID NO: 22425 - protein, 9 aa, Homo sapiens
  Light chain CDR3 for antibody 11213 (IGKV3D-7)
QQDYTLPYT

SEQ ID NO: 22426 - protein, 17 aa, Homo sapiens
  Heavy chain CDR3 for antibody 11213 (IGHV3-23)
AKDTITMVRGALFGMDV

SEQ ID NO: 22427 - protein, 9 aa, Homo sapiens
  Light chain CDR3 for antibody 11214 (IGKV1-33)
QQYDNLPFT

SEQ ID NO: 22428 - protein, 19 aa, Homo sapiens
  Heavy chain CDR3 for antibody 11214 (IGHV3-30)
ARRKNYYGSGSWHYYGMDV

SEQ ID NO: 22429 - protein, 9 aa, Homo sapiens
  Light chain CDR3 for antibody 11215 (IGKV1D-16)
QQYNSFPLT

SEQ ID NO: 22430 - protein, 11 aa, Homo sapiens
  Heavy chain CDR3 for antibody 11215 (IGHV4-59)
ARSIRYAVFDY

SEQ ID NO: 22431 - protein, 9 aa, Homo sapiens
  Light chain CDR3 for antibody 11216 (IGKV1D-13)
QQFNNYPRT

SEQ ID NO: 22432 - protein, 11 aa, Homo sapiens
  Heavy chain CDR3 for antibody 11216 (IGHV3-33)
ARGSGSYAFDY

SEQ ID NO: 22433 - protein, 9 aa, Homo sapiens
  Light chain CDR3 for antibody 11217 (IGKV1-17)
LQLNSFPWT

SEQ ID NO: 22434 - protein, 12 aa, Homo sapiens
  Heavy chain CDR3 for antibody 11217 (IGHV3-33)
TRGYSSKSYFDY

SEQ ID NO: 22435 - protein, 9 aa, Homo sapiens
  Light chain CDR3 for antibody 11218 (IGKV1-17)
QQLNGYPFT

SEQ ID NO: 22436 - protein, 20 aa, Homo sapiens
  Heavy chain CDR3 for antibody 11218 (IGHV3-33)
SRGGATLVRGVIDYYYGMDV

SEQ ID NO: 22437 - protein, 8 aa, Homo sapiens
  Light chain CDR3 for antibody 11219 (IGKV3-20)
QQYGSSLT

SEQ ID NO: 22438 - protein, 18 aa, Homo sapiens
  Heavy chain CDR3 for antibody 11219 (IGHV3-23)
AKDRITGTTYGYYSGLDV

SEQ ID NO: 22439 - protein, 9 aa, Homo sapiens
  Light chain CDR3 for antibody 11220 (IGKV1-6)
LQDYNYPYT

SEQ ID NO: 22440 - protein, 10 aa, Homo sapiens
  Heavy chain CDR3 for antibody 11220 (IGHV4-39)
ASSNWNDGPL

SEQ ID NO: 22441 - protein, 9 aa, Homo sapiens
  Light chain CDR3 for antibody 11221 (IGKV1-37)
QRTSNAPYT

SEQ ID NO: 22442 - protein, 24 aa, Homo sapiens
  Heavy chain CDR3 for antibody 11221 (IGHV3-20)
ARGRITMVRGVIINPLDYYNGMDV

SEQ ID NO: 22443 - protein, 10 aa, Homo sapiens
  Light chain CDR3 for antibody 11222 (IGKV3-11)
QQRSTWPTLT

SEQ ID NO: 22444 - protein, 11 aa, Homo sapiens
  Heavy chain CDR3 for antibody 11222 (IGHV4-59)
AREMGHDTFDI

SEQ ID NO: 22445 - protein, 9 aa, Homo sapiens
  Light chain CDR3 for antibody 11223 (IGKV1-17)
LQHNGYPLT

SEQ ID NO: 22446 - protein, 14 aa, Homo sapiens
  Heavy chain CDR3 for antibody 11223 (IGHV3-33)
ARDGYDILTGPFDY

SEQ ID NO: 22447 - protein, 9 aa, Homo sapiens
  Light chain CDR3 for antibody 11224 (IGKV1D-13)
QRFNNYLYT

SEQ ID NO: 22448 - protein, 11 aa, Homo sapiens
  Heavy chain CDR3 for antibody 11224 (IGHV3-33)
AREGAVARFDY

SEQ ID NO: 22449 - protein, 8 aa, Homo sapiens
  Light chain CDR3 for antibody 11225 (IGKV1D-13)
QQFNNYPT

SEQ ID NO: 22450 - protein, 8 aa, Homo sapiens
  Heavy chain CDR3 for antibody 11225 (IGHV3-20)
APHWIFDY

SEQ ID NO: 22451 - protein, 9 aa, Homo sapiens
  Light chain CDR3 for antibody 11226 (IGKV1-6)
LQDFNYPRT

SEQ ID NO: 22452 - protein, 9 aa, Homo sapiens
  Heavy chain CDR3 for antibody 11226 (IGHV4-59)
ARGGASFAY

SEQ ID NO: 22453 - protein, 10 aa, Homo sapiens
  Light chain CDR3 for antibody 11227 (IGKV1-17)
LQHNSYPMYT

SEQ ID NO: 22454 - protein, 15 aa, Homo sapiens
  Heavy chain CDR3 for antibody 11227 (IGHV1-18)
ARRSPNWGHYYGMDV

SEQ ID NO: 22455 - protein, 9 aa, Homo sapiens
  Light chain CDR3 for antibody 11228 (IGKV1-17)
LHSNNYPPT

SEQ ID NO: 22456 - protein, 12 aa, Homo sapiens
  Heavy chain CDR3 for antibody 11228 (IGHV3-33)
ARDLVGATPFDY

SEQ ID NO: 22457 - protein, 9 aa, Homo sapiens
  Light chain CDR3 for antibody 11229 (IGKV1-39)
QQYYSYPIT

SEQ ID NO: 22458 - protein, 13 aa, Homo sapiens
  Heavy chain CDR3 for antibody 11229 (IGHV4-39)
ARHPPSRDYGMDV

SEQ ID NO: 22459 - protein, 9 aa, Homo sapiens
  Light chain CDR3 for antibody 11230 (IGKV1-9)
QQLKSYPYT

SEQ ID NO: 22460 - protein, 11 aa, Homo sapiens
  Heavy chain CDR3 for antibody 11230 (IGHV1-46)
AREEDLGAFDI

SEQ ID NO: 22461 - protein, 9 aa, Homo sapiens
  Light chain CDR3 for antibody 11231 (IGKV1D-13)
QRFNNYLYT

SEQ ID NO: 22462 - protein, 14 aa, Homo sapiens
  Heavy chain CDR3 for antibody 11231 (IGHV1-18)
ARCFGSGSYGWFDP

SEQ ID NO: 22463 - protein, 9 aa, Homo sapiens
  Light chain CDR3 for antibody 11232 (IGKV1-17)
LQHNSYPYT

SEQ ID NO: 22464 - protein, 15 aa, Homo sapiens
  Heavy chain CDR3 for antibody 11232 (IGHV3-33)
ARRGGIAAAGYYFDY

SEQ ID NO: 22465 - protein, 9 aa, Homo sapiens
  Light chain CDR3 for antibody 11233 (IGKV5-2)
LQHDNFPYT

SEQ ID NO: 22466 - protein, 16 aa, Homo sapiens
  Heavy chain CDR3 for antibody 11233 (IGHV4-59)
ARGRYCDWLLGDVFDI

SEQ ID NO: 22467 - protein, 9 aa, Homo sapiens
  Light chain CDR3 for antibody 11234 (IGKV3-20)
QQYGISPYT

SEQ ID NO: 22468 - protein, 9 aa, Homo sapiens
  Heavy chain CDR3 for antibody 11234 (IGHV1-18)
ARGKDLFDH

SEQ ID NO: 22469 - protein, 9 aa, Homo sapiens
  Light chain CDR3 for antibody 11235 (IGKV3D-7)
QQDYEFPLT

SEQ ID NO: 22470 - protein, 9 aa, Homo sapiens
  Heavy chain CDR3 for antibody 11235 (IGHV1-8)
ARGRLDFDY

SEQ ID NO: 22471 - protein, 7 aa, Homo sapiens
  Light chain CDR3 for antibody 11236 (IGKV1-17)
LQHNSYP

SEQ ID NO: 22472 - protein, 20 aa, Homo sapiens
  Heavy chain CDR3 for antibody 11236 (IGHV3-33)
SRGGATLVRGVIDYYYGMDV

SEQ ID NO: 22473 - protein, 9 aa, Homo sapiens
  Light chain CDR3 for antibody 11237 (IGKV3D-7)
QQDYNLPYT

SEQ ID NO: 22474 - protein, 20 aa, Homo sapiens
  Heavy chain CDR3 for antibody 11237 (IGHV4-59)
ARDRGYDILTGYYGYYGMDV

SEQ ID NO: 22475 - protein, 10 aa, Homo sapiens
  Light chain CDR3 for antibody 11238 (IGKV3-20)
QQYGRSPPVT

SEQ ID NO: 22476 - protein, 18 aa, Homo sapiens
  Heavy chain CDR3 for antibody 11238 (IGHV6-1)
ARDQYSYGPYYYYYGMDV

SEQ ID NO: 22477 - protein, 9 aa, Homo sapiens
  Light chain CDR3 for antibody 11239 (IGKV6-21)
QQSSSLPFT

SEQ ID NO: 22478 - protein, 20 aa, Homo sapiens
  Heavy chain CDR3 for antibody 11239 (IGHV3-33)
ARERCSSTSCYGYYYYGMDV

SEQ ID NO: 22479 - protein, 9 aa, Homo sapiens
  Light chain CDR3 for antibody 11240 (IGKV1-39)
QQSYSTPYT

SEQ ID NO: 22480 - protein, 18 aa, Homo sapiens
  Heavy chain CDR3 for antibody 11240 (IGHV1-46)
ARDGDYVWGSYRSDWFDP

SEQ ID NO: 22481 - protein, 9 aa, Homo sapiens
  Light chain CDR3 for antibody 11241 (IGKV1D-16)
QQYDSYPYT

SEQ ID NO: 22482 - protein, 17 aa, Homo sapiens
  Heavy chain CDR3 for antibody 11241 (IGHV3-33)
ARGYCSRTSCYLYYFDY

SEQ ID NO: 22483 - protein, 9 aa, Homo sapiens
  Light chain CDR3 for antibody 11242 (IGKV1-6)
LQDYNYPYT

SEQ ID NO: 22484 - protein, 18 aa, Homo sapiens
  Heavy chain CDR3 for antibody 11242 (IGHV3-33)
ARDGYSVYDYYYYYGMDV

SEQ ID NO: 22485 - protein, 9 aa, Homo sapiens
  Light chain CDR3 for antibody 11243 (IGKV1D-16)
QQYNSYPFT

SEQ ID NO: 22486 - protein, 12 aa, Homo sapiens
  Heavy chain CDR3 for antibody 11243 (IGHV3-23)
AKEYDILAGCVH

SEQ ID NO: 22487 - protein, 9 aa, Homo sapiens
  Light chain CDR3 for antibody 11244 (IGKV1-9)
QQLISYPLT

SEQ ID NO: 22488 - protein, 12 aa, Homo sapiens
  Heavy chain CDR3 for antibody 11244 (IGHV3-13)
AIGTMVRGIPDY

SEQ ID NO: 22489 - protein, 9 aa, Homo sapiens
  Light chain CDR3 for antibody 11245 (IGKV1D-13)
QHFNNYMYT

SEQ ID NO: 22490 - protein, 20 aa, Homo sapiens
  Heavy chain CDR3 for antibody 11245 (IGHV3-11)
ARGGATLIRGLIDYYYGMDV

SEQ ID NO: 22491 - protein, 9 aa, Homo sapiens
  Light chain CDR3 for antibody 11246 (IGKV1-17)
LQHNSYPYT

SEQ ID NO: 22492 - protein, 11 aa, Homo sapiens
  Heavy chain CDR3 for antibody 11246 (IGHV4-59)
ARDRGHYGMDV

SEQ ID NO: 22493 - protein, 10 aa, Homo sapiens
  Light chain CDR3 for antibody 11247 (IGKV3-15)
QQYNNWPPYT

SEQ ID NO: 22494 - protein, 16 aa, Homo sapiens
  Heavy chain CDR3 for antibody 11247 (IGHV3-33)
ARAVYYGSGSSRIMDV

SEQ ID NO: 22495 - protein, 9 aa, Homo sapiens
  Light chain CDR3 for antibody 11248 (IGKV5-2)
LQHDKFPYT

SEQ ID NO: 22496 - protein, 19 aa, Homo sapiens
  Heavy chain CDR3 for antibody 11248 (IGHV3-33)
ARGVRLRYFDPYYHYGMDV

SEQ ID NO: 22497 - protein, 9 aa, Homo sapiens
  Light chain CDR3 for antibody 11249 (IGKV1-9)
QQLNRYPYT

SEQ ID NO: 22498 - protein, 9 aa, Homo sapiens
  Heavy chain CDR3 for antibody 11249 (IGHV3-30)
ARGRVSLDV

SEQ ID NO: 22499 - protein, 8 aa, Homo sapiens
  Light chain CDR3 for antibody 11250 (IGKV1-5)
QQYNSYYT

SEQ ID NO: 22500 - protein, 12 aa, Homo sapiens
  Heavy chain CDR3 for antibody 11250 (IGHV1-18)
ARVGSSGWYFDY

SEQ ID NO: 22501 - protein, 9 aa, Homo sapiens
  Light chain CDR3 for antibody 11251 (IGKV1-27)
QKYNSAPYT

SEQ ID NO: 22502 - protein, 17 aa, Homo sapiens
  Heavy chain CDR3 for antibody 11251 (IGHV4-39)
AGRLTYYYGSGSPSFDY

SEQ ID NO: 22503 - protein, 8 aa, Homo sapiens
  Light chain CDR3 for antibody 11252 (IGKV3-20)
QQYGSSRT

SEQ ID NO: 22504 - protein, 17 aa, Homo sapiens
  Heavy chain CDR3 for antibody 11252 (IGHV3-33)
ARGFSGYDGYYYYGMDV

SEQ ID NO: 22505 - protein, 9 aa, Homo sapiens
  Light chain CDR3 for antibody 11253 (IGKV1-9)
QQLNSYPLT

SEQ ID NO: 22506 - protein, 12 aa, Homo sapiens
  Heavy chain CDR3 for antibody 11253 (IGHV1-18)
ARLGGFGEFPDC

SEQ ID NO: 22507 - protein, 9 aa, Homo sapiens
  Light chain CDR3 for antibody 11254 (IGKV1-6)
LQDYNYPYT

SEQ ID NO: 22508 - protein, 20 aa, Homo sapiens
  Heavy chain CDR3 for antibody 11254 (IGHV3-23)
AKDGRSGSYDYYYYYYGMDV

SEQ ID NO: 22509 - protein, 10 aa, Homo sapiens
  Light chain CDR3 for antibody 11255 (IGKV1-39)
QQSYSTPMYT

SEQ ID NO: 22510 - protein, 16 aa, Homo sapiens
  Heavy chain CDR3 for antibody 11255 (IGHV3-33)
AREGYSSSWFDRNFDY

SEQ ID NO: 22511 - protein, 9 aa, Homo sapiens
  Light chain CDR3 for antibody 11256 (IGKV1-27)
QKYNSAPYT

SEQ ID NO: 22512 - protein, 12 aa, Homo sapiens
  Heavy chain CDR3 for antibody 11256 (IGHV3-23)
AKDGWFGESLDY

SEQ ID NO: 22513 - protein, 9 aa, Homo sapiens
  Light chain CDR3 for antibody 11257 (IGKV1D-16)
QQYYSYPRT

SEQ ID NO: 22514 - protein, 18 aa, Homo sapiens
  Heavy chain CDR3 for antibody 11257 (IGHV1-46)
ARDLTGRTENYYFYGMDV

SEQ ID NO: 22515 - protein, 9 aa, Homo sapiens
  Light chain CDR3 for antibody 11258 (IGKV1D-16)
QQYNSFPLT

SEQ ID NO: 22516 - protein, 24 aa, Homo sapiens
  Heavy chain CDR3 for antibody 11258 (IGHV1-46)
ARDEARGLLTGYYNMREYYYGMDV

SEQ ID NO: 22517 - protein, 9 aa, Homo sapiens
  Light chain CDR3 for antibody 11259 (IGKV1-17)
LQHNSYPYT

SEQ ID NO: 22518 - protein, 15 aa, Homo sapiens
  Heavy chain CDR3 for antibody 11259 (IGHV3-33)
ASRDILTGYYEWFDP

SEQ ID NO: 22519 - protein, 10 aa, Homo sapiens
  Light chain CDR3 for antibody 11260 (IGKV1-39)
QQSYSTPMYT

SEQ ID NO: 22520 - protein, 19 aa, Homo sapiens
  Heavy chain CDR3 for antibody 11260 (IGHV3-33)
AREDYYGSGSYYNEDWFDP

SEQ ID NO: 22521 - protein, 9 aa, Homo sapiens
  Light chain CDR3 for antibody 11261 (IGKV1-9)
QQLNSYPRT

SEQ ID NO: 22522 - protein, 17 aa, Homo sapiens
  Heavy chain CDR3 for antibody 11261 (IGHV1-18)
ARDRACTMVRGVPPFDY

SEQ ID NO: 22523 - protein, 9 aa, Homo sapiens
  Light chain CDR3 for antibody 11262 (IGKV3-11)
QQRSNWMYT

SEQ ID NO: 22524 - protein, 17 aa, Homo sapiens
  Heavy chain CDR3 for antibody 11262 (IGHV3-23)
AKEGSSSSWYGGLYFDY

SEQ ID NO: 22525 - protein, 8 aa, Homo sapiens
  Light chain CDR3 for antibody 11263 (IGKV3-20)
QQYGSSLT

SEQ ID NO: 22526 - protein, 18 aa, Homo sapiens
  Heavy chain CDR3 for antibody 11263 (IGHV3-11)
ARDGYYGSGSFYYYGMDV

SEQ ID NO: 22527 - protein, 9 aa, Homo sapiens
  Light chain CDR3 for antibody 11264 (IGKV1-9)
QQLISYPLT

SEQ ID NO: 22528 - protein, 17 aa, Homo sapiens
  Heavy chain CDR3 for antibody 11264 (IGHV3-23)
AKEYCSGGSCYVYYFDY

SEQ ID NO: 22529 - protein, 9 aa, Homo sapiens
  Light chain CDR3 for antibody 11265 (IGKV1D-13)
QQFNNYPHT

SEQ ID NO: 22530 - protein, 11 aa, Homo sapiens
  Heavy chain CDR3 for antibody 11265 (IGHV3-33)
ARDRGYSYFDY

SEQ ID NO: 22531 - protein, 10 aa, Homo sapiens
  Light chain CDR3 for antibody 11266 (IGKV3-11)
QQRSNWPALT

SEQ ID NO: 22532 - protein, 14 aa, Homo sapiens
  Heavy chain CDR3 for antibody 11266 (IGHV3-33)
ARDRRDFYYYGMDV

SEQ ID NO: 22533 - protein, 9 aa, Homo sapiens
  Light chain CDR3 for antibody 11267 (IGKV1-27)
QKYNSAPLT

SEQ ID NO: 22534 - protein, 13 aa, Homo sapiens
  Heavy chain CDR3 for antibody 11267 (IGHV3-h)
ARYRYSGYGAFDY

SEQ ID NO: 22535 - protein, 11 aa, Homo sapiens
  Light chain CDR3 for antibody 11268 (IGKV3-11)
QQRSIWPPTWT

SEQ ID NO: 22536 - protein, 15 aa, Homo sapiens
  Heavy chain CDR3 for antibody 11268 (IGHV4-39)
ARQGLVATIKGYFQH

SEQ ID NO: 22537 - protein, 10 aa, Homo sapiens
  Light chain CDR3 for antibody 11269 (IGKV1-39)
QQSYSTPMYT

SEQ ID NO: 22538 - protein, 20 aa, Homo sapiens
  Heavy chain CDR3 for antibody 11269 (IGHV1-f)
ATHYDILTGSPYYYYCALDV

SEQ ID NO: 22539 - protein, 9 aa, Homo sapiens
  Light chain CDR3 for antibody 11270 (IGKV1-6)
LQDYNYPYT

SEQ ID NO: 22540 - protein, 15 aa, Homo sapiens
  Heavy chain CDR3 for antibody 11270 (IGHV3-33)
ARDGSSSWSPSWFDP

SEQ ID NO: 22541 - protein, 8 aa, Homo sapiens
  Light chain CDR3 for antibody 11271 (IGKV1-5)
QQYHSYYT

SEQ ID NO: 22542 - protein, 15 aa, Homo sapiens
  Heavy chain CDR3 for antibody 11271 (IGHV3-33)
ARRSILTGSYWYFDL

SEQ ID NO: 22543 - protein, 9 aa, Homo sapiens
  Light chain CDR3 for antibody 11272 (IGKV6-21)
HQSSSLPFT

SEQ ID NO: 22544 - protein, 16 aa, Homo sapiens
  Heavy chain CDR3 for antibody 11272 (IGHV3-33)
ARDQGILTGYYTAIDY

SEQ ID NO: 22545 - protein, 10 aa, Homo sapiens
  Light chain CDR3 for antibody 11273 (IGKV1-9)
QQLDSYPMYT

SEQ ID NO: 22546 - protein, 8 aa, Homo sapiens
  Heavy chain CDR3 for antibody 11273 (IGHV3-23)
AETFLFDY

SEQ ID NO: 22547 - protein, 9 aa, Homo sapiens
  Light chain CDR3 for antibody 11274 (IGKV1-9)
QQLKSYLYT

SEQ ID NO: 22548 - protein, 16 aa, Homo sapiens
  Heavy chain CDR3 for antibody 11274 (IGHV3-33)
AREVAGSYYYYYGIDV

SEQ ID NO: 22549 - protein, 10 aa, Homo sapiens
  Light chain CDR3 for antibody 11275 (IGKV1-17)
LQHNSYPMYT

SEQ ID NO: 22550 - protein, 14 aa, Homo sapiens
  Heavy chain CDR3 for antibody 11275 (IGHV3-33)
ARQYSYGYPYYLDY

SEQ ID NO: 22551 - protein, 9 aa, Homo sapiens
  Light chain CDR3 for antibody 11276 (IGKV1D-16)
QQLNSYPWT

SEQ ID NO: 22552 - protein, 12 aa, Homo sapiens
  Heavy chain CDR3 for antibody 11276 (IGHV3-33)
ARESGGSYSFDY

SEQ ID NO: 22553 - protein, 9 aa, Homo sapiens
  Light chain CDR3 for antibody 11277 (IGKV3D-20)
QQFGSLPLT

SEQ ID NO: 22554 - protein, 14 aa, Homo sapiens
  Heavy chain CDR3 for antibody 11277 (IGHV4-39)
ARDSGYDYYYGMDV

SEQ ID NO: 22555 - protein, 9 aa, Homo sapiens
  Light chain CDR3 for antibody 11278 (IGKV5-2)
LQHDNFPWT

SEQ ID NO: 22556 - protein, 14 aa, Homo sapiens
  Heavy chain CDR3 for antibody 11278 (IGHV3-66)
ARRGVIVPAAGFDP

SEQ ID NO: 22557 - protein, 9 aa, Homo sapiens
  Light chain CDR3 for antibody 11279 (IGKV1-9)
QQGNTYSRT

SEQ ID NO: 22558 - protein, 17 aa, Homo sapiens
  Heavy chain CDR3 for antibody 11279 (IGHV1-24)
ATEGYDILHGYYNVLDY

SEQ ID NO: 22559 - protein, 8 aa, Homo sapiens
  Light chain CDR3 for antibody 11280 (IGKV3D-7)
QQDYNLLT

SEQ ID NO: 22560 - protein, 12 aa, Homo sapiens
  Heavy chain CDR3 for antibody 11280 (IGHV3-33)
AKDPGWQQLAEY

SEQ ID NO: 22561 - protein, 8 aa, Homo sapiens
  Light chain CDR3 for antibody 11281 (IGKV3-15)
QQYNNYPT

SEQ ID NO: 22562 - protein, 13 aa, Homo sapiens
  Heavy chain CDR3 for antibody 11281 (IGHV3-33)
AREYFDWLLPLDY

SEQ ID NO: 22563 - protein, 9 aa, Homo sapiens
  Light chain CDR3 for antibody 11282 (IGKV1D-16)
QQCNSYPRT

SEQ ID NO: 22564 - protein, 16 aa, Homo sapiens
  Heavy chain CDR3 for antibody 11282 (IGHV3-23)
AKDGIGELSYYYGMDV

SEQ ID NO: 22565 - protein, 9 aa, Homo sapiens
  Light chain CDR3 for antibody 11283 (IGKV3-11)
QQRSDWPLT

SEQ ID NO: 22566 - protein, 17 aa, Homo sapiens
  Heavy chain CDR3 for antibody 11283 (IGHV3-33)
ARSGIVGATDYYYGLDV

SEQ ID NO: 22567 - protein, 9 aa, Homo sapiens
  Light chain CDR3 for antibody 11284 (IGKV2-30)
MQGIHWPLT

SEQ ID NO: 22568 - protein, 17 aa, Homo sapiens
  Heavy chain CDR3 for antibody 11284 (IGHV3-33)
ARSPYDILTGYSYYLDY

SEQ ID NO: 22569 - protein, 9 aa, Homo sapiens
  Light chain CDR3 for antibody 11285 (IGKV1D-13)
QRFNNYLYT

SEQ ID NO: 22570 - protein, 18 aa, Homo sapiens
  Heavy chain CDR3 for antibody 11285 (IGHV3-33)
ARDGRISLVRGIIDAFDI

SEQ ID NO: 22571 - protein, 9 aa, Homo sapiens
  Light chain CDR3 for antibody 11286 (IGKV3D-20)
QQYGYSPLT

SEQ ID NO: 22572 - protein, 13 aa, Homo sapiens
  Heavy chain CDR3 for antibody 11286 (IGHV3-33)
ARRYSSGWYPFDY

SEQ ID NO: 22573 - protein, 9 aa, Homo sapiens
  Light chain CDR3 for antibody 11287 (IGKV2-30)
MQGTHWPLT

SEQ ID NO: 22574 - protein, 13 aa, Homo sapiens
  Heavy chain CDR3 for antibody 11287 (IGHV3-11)
ARDGYSYGPYFDY

SEQ ID NO: 22575 - protein, 9 aa, Homo sapiens
  Light chain CDR3 for antibody 11288 (IGKV3-11)
QQRSSWPPT

SEQ ID NO: 22576 - protein, 15 aa, Homo sapiens
  Heavy chain CDR3 for antibody 11288 (IGHV3-23)
AKEALRYFDWSGMDV

SEQ ID NO: 22577 - protein, 9 aa, Homo sapiens
  Light chain CDR3 for antibody 11289 (IGKV3-11)
QQRSSWPPT

SEQ ID NO: 22578 - protein, 12 aa, Homo sapiens
  Heavy chain CDR3 for antibody 11289 (IGHV4-39)
ARDSGSYYFFDY

SEQ ID NO: 22579 - protein, 9 aa, Homo sapiens
  Light chain CDR3 for antibody 11290 (IGKV1-27)
QQYINWPLT

SEQ ID NO: 22580 - protein, 17 aa, Homo sapiens
  Heavy chain CDR3 for antibody 11290 (IGHV4-61)
ARNTMVGTWQRQGNLDH

SEQ ID NO: 22581 - protein, 10 aa, Homo sapiens
  Light chain CDR3 for antibody 11291 (IGKV1-39)
QQSYSTPMYT

SEQ ID NO: 22582 - protein, 9 aa, Homo sapiens
  Heavy chain CDR3 for antibody 11291 (IGHV3-33)
AREYKEFDY

SEQ ID NO: 22583 - protein, 9 aa, Homo sapiens
  Light chain CDR3 for antibody 11292 (IGKV3-11)
QQRSNWMYT

SEQ ID NO: 22584 - protein, 24 aa, Homo sapiens
  Heavy chain CDR3 for antibody 11292 (IGHV1-46)
ARDEARGLLTGYYNMREYYYGMDV

SEQ ID NO: 22585 - protein, 9 aa, Homo sapiens
  Light chain CDR3 for antibody 11293 (IGKV1-27)
QKYNSAPYT

SEQ ID NO: 22586 - protein, 18 aa, Homo sapiens
  Heavy chain CDR3 for antibody 11293 (IGHV3-33)
ARKGGYYSGSGSYRHFDF

SEQ ID NO: 22587 - protein, 8 aa, Homo sapiens
  Light chain CDR3 for antibody 11294 (IGKV3-20)
QQYGSSPT

SEQ ID NO: 22588 - protein, 24 aa, Homo sapiens
  Heavy chain CDR3 for antibody 11294 (IGHV1-46)
AGPITMVRGVIIPDYYYYYYGMDV

SEQ ID NO: 22589 - protein, 10 aa, Homo sapiens
  Light chain CDR3 for antibody 11295 (IGKV3-11)
QQRSNWPTWT

SEQ ID NO: 22590 - protein, 13 aa, Homo sapiens
  Heavy chain CDR3 for antibody 11295 (IGHV1-18)
ARSITMVRGVIGY

SEQ ID NO: 22591 - protein, 9 aa, Homo sapiens
  Light chain CDR3 for antibody 11296 (IGKV1D-16)
LQDYKSPFT

SEQ ID NO: 22592 - protein, 19 aa, Homo sapiens
  Heavy chain CDR3 for antibody 11296 (IGHV3-23)
AKDGRSGSYDYYYYYGMDV

SEQ ID NO: 22593 - protein, 9 aa, Homo sapiens
  Light chain CDR3 for antibody 11297 (IGKV1-17)
LQLNSFPWT

SEQ ID NO: 22594 - protein, 13 aa, Homo sapiens
  Heavy chain CDR3 for antibody 11297 (IGHV4-59)
ARAAWYSSSWFDY

SEQ ID NO: 22595 - protein, 9 aa, Homo sapiens
  Light chain CDR3 for antibody 11298 (IGKV1-9)
QQVKSYPYT

SEQ ID NO: 22596 - protein, 18 aa, Homo sapiens
  Heavy chain CDR3 for antibody 11298 (IGHV1-46)
ARDLTGRTENYYFYGMDV

SEQ ID NO: 22597 - protein, 9 aa, Homo sapiens
  Light chain CDR3 for antibody 11299 (IGKV3-15)
QQYNNWPYT

SEQ ID NO: 22598 - protein, 20 aa, Homo sapiens
  Heavy chain CDR3 for antibody 11299 (IGHV3-33)
ARRMVRGVKKTYYYYYGLDV

SEQ ID NO: 22599 - protein, 9 aa, Homo sapiens
  Light chain CDR3 for antibody 11300 (IGKV1-6)
LQDFHYPWT

SEQ ID NO: 22600 - protein, 13 aa, Homo sapiens
  Heavy chain CDR3 for antibody 11300 (IGHV3-53)
ASPFNWNDGFFDY

SEQ ID NO: 22601 - protein, 10 aa, Homo sapiens
  Light chain CDR3 for antibody 11301 (IGKV1-39)
QQSYSTPMYT

SEQ ID NO: 22602 - protein, 17 aa, Homo sapiens
  Heavy chain CDR3 for antibody 11301 (IGHV3-33)
ARDSYDILTGYYKPFDY

SEQ ID NO: 22603 - protein, 10 aa, Homo sapiens
  Light chain CDR3 for antibody 11302 (IGKV3-11)
QQRSNWPTWT

SEQ ID NO: 22604 - protein, 13 aa, Homo sapiens
  Heavy chain CDR3 for antibody 11302 (IGHV3-33)
ASTGDSYYYGMDV

SEQ ID NO: 22605 - protein, 9 aa, Homo sapiens
  Light chain CDR3 for antibody 11303 (IGKV1-33)
QQYDNLPFT

SEQ ID NO: 22606 - protein, 17 aa, Homo sapiens
  Heavy chain CDR3 for antibody 11303 (IGHV3-33)
ARCGYSSSWYDPYYFDY

SEQ ID NO: 22607 - protein, 9 aa, Homo sapiens
  Light chain CDR3 for antibody 11304 (IGKV1-17)
LHSNNYPWT

SEQ ID NO: 22608 - protein, 13 aa, Homo sapiens
  Heavy chain CDR3 for antibody 11304 (IGHV4-39)
ARREVVGGRGFDY

SEQ ID NO: 22609 - protein, 9 aa, Homo sapiens
  Light chain CDR3 for antibody 11305 (IGKV1-9)
QQLNSYPRT

SEQ ID NO: 22610 - protein, 9 aa, Homo sapiens
  Heavy chain CDR3 for antibody 11305 (IGHV1-8)
ARGSLDFDY

SEQ ID NO: 22611 - protein, 11 aa, Homo sapiens
  Light chain CDR3 for antibody 11306 (IGKV3-11)
QQRSNWPPTWT

SEQ ID NO: 22612 - protein, 14 aa, Homo sapiens
  Heavy chain CDR3 for antibody 11306 (IGHV3-33)
AREGYSSNWYDFDY

SEQ ID NO: 22613 - protein, 9 aa, Homo sapiens
  Light chain CDR3 for antibody 11307 (IGKV1D-13)
QQFNNYPYT

SEQ ID NO: 22614 - protein, 16 aa, Homo sapiens
  Heavy chain CDR3 for antibody 11307 (IGHV3-33)
ARGANYYGSGIPNFEY

SEQ ID NO: 22615 - protein, 9 aa, Homo sapiens
  Light chain CDR3 for antibody 11308 (IGKV2D-28)
MQALQTPPT

SEQ ID NO: 22616 - protein, 21 aa, Homo sapiens
  Heavy chain CDR3 for antibody 11308 (IGHV3-33)
ARKRLYDILTGYYKAYYGMDV

SEQ ID NO: 22617 - protein, 9 aa, Homo sapiens
  Light chain CDR3 for antibody 11309 (IGKV1-6)
LQDYNYPWT

SEQ ID NO: 22618 - protein, 16 aa, Homo sapiens
  Heavy chain CDR3 for antibody 11309 (IGHV3-33)
ARDAKYYDILTGYHDY

SEQ ID NO: 22619 - protein, 8 aa, Homo sapiens
  Light chain CDR3 for antibody 11310 (IGKV1D-13)
QQFNNYPT

SEQ ID NO: 22620 - protein, 18 aa, Homo sapiens
  Heavy chain CDR3 for antibody 11310 (IGHV4-39)
ARQYYFGSGNYYRGWFDP

SEQ ID NO: 22621 - protein, 9 aa, Homo sapiens
  Light chain CDR3 for antibody 11311 (IGKV5-2)
LQHDNFPWT

SEQ ID NO: 22622 - protein, 10 aa, Homo sapiens
  Heavy chain CDR3 for antibody 11311 (IGHV4-59)
VSSGTSLLAY

SEQ ID NO: 22623 - protein, 9 aa, Homo sapiens
  Light chain CDR3 for antibody 11312 (IGKV2-30)
MQGTHWPLT

SEQ ID NO: 22624 - protein, 15 aa, Homo sapiens
  Heavy chain CDR3 for antibody 11312 (IGHV3-11)
ARDLGYYGSGSRMDV

SEQ ID NO: 22625 - protein, 8 aa, Homo sapiens
  Light chain CDR3 for antibody 11313 (IGKV3-20)
QQYGSSLT

SEQ ID NO: 22626 - protein, 17 aa, Homo sapiens
  Heavy chain CDR3 for antibody 11313 (IGHV4-59)
ARDRELLWFGEFGGMDV

SEQ ID NO: 22627 - protein, 8 aa, Homo sapiens
  Light chain CDR3 for antibody 11314 (IGKV1D-13)
QQFNNYYT

SEQ ID NO: 22628 - protein, 12 aa, Homo sapiens
  Heavy chain CDR3 for antibody 11314 (IGHV3-33)
AREGTGGNWFDP

SEQ ID NO: 22629 - protein, 8 aa, Homo sapiens
  Light chain CDR3 for antibody 11315 (IGKV1D-13)
QQFNNYYT

SEQ ID NO: 22630 - protein, 14 aa, Homo sapiens
  Heavy chain CDR3 for antibody 11315 (IGHV1-2)
ARDYYGSGNYYMGY

SEQ ID NO: 22631 - protein, 10 aa, Homo sapiens
  Light chain CDR3 for antibody 11316 (IGKV3-20)
QQYGRSPPVT

SEQ ID NO: 22632 - protein, 11 aa, Homo sapiens
  Heavy chain CDR3 for antibody 11316 (IGHV3-23)
GEFSSGWSFDY

SEQ ID NO: 22633 - protein, 9 aa, Homo sapiens
  Light chain CDR3 for antibody 11317 (IGKV1-16)
QHYNDYPFT

SEQ ID NO: 22634 - protein, 14 aa, Homo sapiens
  Heavy chain CDR3 for antibody 11317 (IGHV3-33)
ARAISGSSYWYFDL

SEQ ID NO: 22635 - protein, 9 aa, Homo sapiens
  Light chain CDR3 for antibody 11318 (IGKV1-39)
QQGFSTPWT

SEQ ID NO: 22636 - protein, 14 aa, Homo sapiens
  Heavy chain CDR3 for antibody 11318 (IGHV4-39)
ARQGTMIRGGYFDY

SEQ ID NO: 22637 - protein, 9 aa, Homo sapiens
  Light chain CDR3 for antibody 11319 (IGKV2-30)
MQGTHWPLT

SEQ ID NO: 22638 - protein, 16 aa, Homo sapiens
  Heavy chain CDR3 for antibody 11319 (IGHV1-24)
ATDWNDRGYYYYGMDV

SEQ ID NO: 22639 - protein, 10 aa, Homo sapiens
  Light chain CDR3 for antibody 11320 (IGKV1-39)
QQSYSTPMYT

SEQ ID NO: 22640 - protein, 17 aa, Homo sapiens
  Heavy chain CDR3 for antibody 11320 (IGHV3-33)
ARGGAAAGPYLYYGLDV

SEQ ID NO: 22641 - protein, 10 aa, Homo sapiens
  Light chain CDR3 for antibody 11321 (IGKV1-17)
LQHNSYPIYT

SEQ ID NO: 22642 - protein, 17 aa, Homo sapiens
  Heavy chain CDR3 for antibody 11321 (IGHV4-39)
AGRLTYYFGSGSPSFDY

SEQ ID NO: 22643 - protein, 9 aa, Homo sapiens
  Light chain CDR3 for antibody 11322 (IGKV1-27)
QKYNSAPYT

SEQ ID NO: 22644 - protein, 22 aa, Homo sapiens
  Heavy chain CDR3 for antibody 11322 (IGHV3-11)
AKDDLPYYDILTHSTTTGCMDV

SEQ ID NO: 22645 - protein, 9 aa, Homo sapiens
  Light chain CDR3 for antibody 11323 (IGKV1-33)
QQYDNLPFT

SEQ ID NO: 22646 - protein, 15 aa, Homo sapiens
  Heavy chain CDR3 for antibody 11323 (IGHV3-20)
ARDRGSSGWRDWFDP

SEQ ID NO: 22647 - protein, 10 aa, Homo sapiens
  Light chain CDR3 for antibody 11324 (IGKV1-17)
LQHNSYPMYT

SEQ ID NO: 22648 - protein, 14 aa, Homo sapiens
  Heavy chain CDR3 for antibody 11324 (IGHV3-33)
ARDGYDILTGPMDV

SEQ ID NO: 22649 - protein, 9 aa, Homo sapiens
  Light chain CDR3 for antibody 11325 (IGKV3D-7)
QQDSNLPYT

SEQ ID NO: 22650 - protein, 26 aa, Homo sapiens
  Heavy chain CDR3 for antibody 11325 (IGHV4-39)
ARQGLLWFGDLKAYDSSGYYYGYCHH

SEQ ID NO: 22651 - protein, 9 aa, Homo sapiens
  Light chain CDR3 for antibody 11326 (IGKV5-2)
LQHDNFPWT

SEQ ID NO: 22652 - protein, 14 aa, Homo sapiens
  Heavy chain CDR3 for antibody 11326 (IGHV3-23)
AKGGDILTGYYTDY

SEQ ID NO: 22653 - protein, 9 aa, Homo sapiens
  Light chain CDR3 for antibody 11327 (IGKV1-6)
LQDYNYPWT

SEQ ID NO: 22654 - protein, 14 aa, Homo sapiens
  Heavy chain CDR3 for antibody 11327 (IGHV3-33)
ARGDGDILTGYLDY

SEQ ID NO: 22655 - protein, 9 aa, Homo sapiens
  Light chain CDR3 for antibody 11328 (IGKV1-16)
QQYNNYPRT

SEQ ID NO: 22656 - protein, 15 aa, Homo sapiens
  Heavy chain CDR3 for antibody 11328 (IGHV1-2)
ARDLGYYGSGSRMDV

SEQ ID NO: 22657 - protein, 8 aa, Homo sapiens
  Light chain CDR3 for antibody 11329 (IGKV3-20)
QQYGSSLT

SEQ ID NO: 22658 - protein, 15 aa, Homo sapiens
  Heavy chain CDR3 for antibody 11329 (IGHV3-33)
ARDHLTGYYYYGMDV

SEQ ID NO: 22659 - protein, 8 aa, Homo sapiens
  Light chain CDR3 for antibody 11330 (IGKV6-21)
HQSSSLYT

SEQ ID NO: 22660 - protein, 11 aa, Homo sapiens
  Heavy chain CDR3 for antibody 11330 (IGHV4-59)
ARSLRYSFFDY

SEQ ID NO: 22661 - protein, 9 aa, Homo sapiens
  Light chain CDR3 for antibody 11331 (IGKV3-15)
QQYNNWPRT

SEQ ID NO: 22662 - protein, 11 aa, Homo sapiens
  Heavy chain CDR3 for antibody 11331 (IGHV3-33)
ARDILTGFLDH

SEQ ID NO: 22663 - protein, 9 aa, Homo sapiens
  Light chain CDR3 for antibody 11332 (IGKV3D-20)
QQYGYSPRT

SEQ ID NO: 22664 - protein, 11 aa, Homo sapiens
  Heavy chain CDR3 for antibody 11332 (IGHV4-59)
ARSLRYSVFDY

SEQ ID NO: 22665 - protein, 9 aa, Homo sapiens
  Light chain CDR3 for antibody 11333 (IGKV2-30)
MQGTHWPLT

SEQ ID NO: 22666 - protein, 18 aa, Homo sapiens
  Heavy chain CDR3 for antibody 11333 (IGHV3-33)
ARRTAAGTGDYYYYGMDV

SEQ ID NO: 22667 - protein, 9 aa, Homo sapiens
  Light chain CDR3 for antibody 11334 (IGKV3-20)
QQYHSYPYT

SEQ ID NO: 22668 - protein, 13 aa, Homo sapiens
  Heavy chain CDR3 for antibody 11334 (IGHV1-46)
ARDAGYSSSLFDY

SEQ ID NO: 22669 - protein, 9 aa, Homo sapiens
  Light chain CDR3 for antibody 11335 (IGKV1-37)
QRTSNAPYT

SEQ ID NO: 22670 - protein, 14 aa, Homo sapiens
  Heavy chain CDR3 for antibody 11335 (IGHV3-33)
ARGAAAGNFYGLDV

SEQ ID NO: 22671 - protein, 9 aa, Homo sapiens
  Light chain CDR3 for antibody 11336 (IGKV1-6)
LQDYNYPWT

SEQ ID NO: 22672 - protein, 11 aa, Homo sapiens
  Heavy chain CDR3 for antibody 11336 (IGHV3-23)
AKEQKEAAMGA

SEQ ID NO: 22673 - protein, 9 aa, Homo sapiens
  Light chain CDR3 for antibody 11337 (IGKV1D-16)
QQLISYQLT

SEQ ID NO: 22674 - protein, 14 aa, Homo sapiens
  Heavy chain CDR3 for antibody 11337 (IGHV3-33)
ARASSGSSYWYFDL

SEQ ID NO: 22675 - protein, 9 aa, Homo sapiens
  Light chain CDR3 for antibody 11338 (IGKV1-39)
QQSYRTPLT

SEQ ID NO: 22676 - protein, 17 aa, Homo sapiens
  Heavy chain CDR3 for antibody 11338 (IGHV3-64)
ARERYYGSGSYYSWFDP

SEQ ID NO: 22677 - protein, 9 aa, Homo sapiens
  Light chain CDR3 for antibody 11339 (IGKV1-5)
LQHNSYPYT

SEQ ID NO: 22678 - protein, 16 aa, Homo sapiens
  Heavy chain CDR3 for antibody 11339 (IGHV3-33)
ARERVYYFGAGSYFDY

SEQ ID NO: 22679 - protein, 9 aa, Homo sapiens
  Light chain CDR3 for antibody 11340 (IGKV1-9)
QQLNSYPYT

SEQ ID NO: 22680 - protein, 12 aa, Homo sapiens
  Heavy chain CDR3 for antibody 11340 (IGHV4-59)
AKDGYSYGYFDY

SEQ ID NO: 22681 - protein, 9 aa, Homo sapiens
  Light chain CDR3 for antibody 11341 (IGKV2-30)
MQGTHWPLT

SEQ ID NO: 22682 - protein, 15 aa, Homo sapiens
  Heavy chain CDR3 for antibody 11341 (IGHV3-33)
ARHSSGFYYYYGMDV

SEQ ID NO: 22683 - protein, 9 aa, Homo sapiens
  Light chain CDR3 for antibody 11342 (IGKV1-33)
QQYDNLPFT

SEQ ID NO: 22684 - protein, 14 aa, Homo sapiens
  Heavy chain CDR3 for antibody 11342 (IGHV3-33)
ARRGYSGYDWYFDY

SEQ ID NO: 22685 - protein, 9 aa, Homo sapiens
  Light chain CDR3 for antibody 11343 (IGKV3-20)
QQYGSSIFT

SEQ ID NO: 22686 - protein, 15 aa, Homo sapiens
  Heavy chain CDR3 for antibody 11343 (IGHV3-23)
AKEALRYFDWSGMDV

SEQ ID NO: 22687 - protein, 9 aa, Homo sapiens
  Light chain CDR3 for antibody 11344 (IGKV4-1)
QQYYTTPPT

SEQ ID NO: 22688 - protein, 9 aa, Homo sapiens
  Heavy chain CDR3 for antibody 11344 (IGHV4-59)
AREGGSGSL

SEQ ID NO: 22689 - protein, 9 aa, Homo sapiens
  Light chain CDR3 for antibody 11345 (IGKV1-6)
LQDYNYPWT

SEQ ID NO: 22690 - protein, 11 aa, Homo sapiens
  Heavy chain CDR3 for antibody 11345 (IGHV3-33)
ARDWSSGPFDY

SEQ ID NO: 22691 - protein, 9 aa, Homo sapiens
  Light chain CDR3 for antibody 11346 (IGKV3-20)
QQFGRSPRT

SEQ ID NO: 22692 - protein, 15 aa, Homo sapiens
  Heavy chain CDR3 for antibody 11346 (IGHV3-30)
ARGAMVRGVDYGMDV

SEQ ID NO: 22693 - protein, 8 aa, Homo sapiens
  Light chain CDR3 for antibody 11347 (IGKV1-27)
QQYNNYPT

SEQ ID NO: 22694 - protein, 10 aa, Homo sapiens
  Heavy chain CDR3 for antibody 11347 (IGHV3-33)
ARDVVVYFDY

SEQ ID NO: 22695 - protein, 9 aa, Homo sapiens
  Light chain CDR3 for antibody 11348 (IGKV3-20)
QQYGSSPWT

SEQ ID NO: 22696 - protein, 17 aa, Homo sapiens
  Heavy chain CDR3 for antibody 11348 (IGHV1-2)
ARAGAAGTPYYYYYMDV

SEQ ID NO: 22697 - protein, 8 aa, Homo sapiens
  Light chain CDR3 for antibody 11349 (IGKV6-21)
HQSSSLPT

SEQ ID NO: 22698 - protein, 13 aa, Homo sapiens
  Heavy chain CDR3 for antibody 11349 (IGHV3-23)
ARDPLYSGSYFDY

SEQ ID NO: 22699 - protein, 9 aa, Homo sapiens
  Light chain CDR3 for antibody 11350 (IGKV6-21)
HQSSSLPYT

SEQ ID NO: 22700 - protein, 15 aa, Homo sapiens
  Heavy chain CDR3 for antibody 11350 (IGHV4-59)
ARDLGYYGSGSPLAY

SEQ ID NO: 22701 - protein, 9 aa, Homo sapiens
  Light chain CDR3 for antibody 11351 (IGKV3-15)
QQYNDWPLT

SEQ ID NO: 22702 - protein, 9 aa, Homo sapiens
  Heavy chain CDR3 for antibody 11351 (IGHV3-23)
AKEQLLFDY

SEQ ID NO: 22703 - protein, 9 aa, Homo sapiens
  Light chain CDR3 for antibody 11352 (IGKV1-39)
QQGFSTPWT

SEQ ID NO: 22704 - protein, 17 aa, Homo sapiens
  Heavy chain CDR3 for antibody 11352 (IGHV4-39)
ARQYYFGSGNYYSHFHY

SEQ ID NO: 22705 - protein, 9 aa, Homo sapiens
  Light chain CDR3 for antibody 11353 (IGKV1-37)
QRTYNAPFT

SEQ ID NO: 22706 - protein, 14 aa, Homo sapiens
  Heavy chain CDR3 for antibody 11353 (IGHV3-33)
AREGYSSNWYDFDY

SEQ ID NO: 22707 - protein, 9 aa, Homo sapiens
  Light chain CDR3 for antibody 11354 (IGKV5-2)
LQHDKFPYT

SEQ ID NO: 22708 - protein, 20 aa, Homo sapiens
  Heavy chain CDR3 for antibody 11354 (IGHV3-33)
ARDPAQLERQYYYSYYGMDV

SEQ ID NO: 22709 - protein, 9 aa, Homo sapiens
  Light chain CDR3 for antibody 11355 (IGKV1-33)
QQYDNLPFT

SEQ ID NO: 22710 - protein, 12 aa, Homo sapiens
  Heavy chain CDR3 for antibody 11355 (IGHV1-46)
ARGLIGDHASDI

SEQ ID NO: 22711 - protein, 9 aa, Homo sapiens
  Light chain CDR3 for antibody 11356 (IGKV1D-16)
QQYNSYPLT

SEQ ID NO: 22712 - protein, 21 aa, Homo sapiens
  Heavy chain CDR3 for antibody 11356 (IGHV4-59)
ARGPSRYDILTGYSYYYGMDV

SEQ ID NO: 22713 - protein, 9 aa, Homo sapiens
  Light chain CDR3 for antibody 11357 (IGKV1D-16)
QQYNSYPYT

SEQ ID NO: 22714 - protein, 17 aa, Homo sapiens
  Heavy chain CDR3 for antibody 11357 (IGHV1-18)
ARERYYGSGSYKDKMDV

SEQ ID NO: 22715 - protein, 8 aa, Homo sapiens
  Light chain CDR3 for antibody 11358 (IGKV3-11)
LQRGNWPT

SEQ ID NO: 22716 - protein, 20 aa, Homo sapiens
  Heavy chain CDR3 for antibody 11358 (IGHV3-20)
ARDLCSSTSCYGYYYYGMDV

SEQ ID NO: 22717 - protein, 9 aa, Homo sapiens
  Light chain CDR3 for antibody 11359 (IGKV1-37)
QRTYNAPYT

SEQ ID NO: 22718 - protein, 12 aa, Homo sapiens
  Heavy chain CDR3 for antibody 11359 (IGHV3-33)
AREKGGSYSFDY

SEQ ID NO: 22719 - protein, 8 aa, Homo sapiens
  Light chain CDR3 for antibody 11360 (IGKV1-5)
QQYNSYST

SEQ ID NO: 22720 - protein, 18 aa, Homo sapiens
  Heavy chain CDR3 for antibody 11360 (IGHV3-33)
ARGGVLYDILTGFYGMDV

SEQ ID NO: 22721 - protein, 9 aa, Homo sapiens
  Light chain CDR3 for antibody 11361 (IGKV3-11)
QQRSKWPPT

SEQ ID NO: 22722 - protein, 9 aa, Homo sapiens
  Heavy chain CDR3 for antibody 11361 (IGHV1-18)
ARGKDWFDP

SEQ ID NO: 22723 - protein, 9 aa, Homo sapiens
  Light chain CDR3 for antibody 11362 (IGKV1-6)
LQDYNYPWT

SEQ ID NO: 22724 - protein, 18 aa, Homo sapiens
  Heavy chain CDR3 for antibody 11362 (IGHV3-33)
SRGGATLGRGVIDYGMDV

SEQ ID NO: 22725 - protein, 8 aa, Homo sapiens
  Light chain CDR3 for antibody 11363 (IGKV3D-7)
QQDYNLPT

SEQ ID NO: 22726 - protein, 9 aa, Homo sapiens
  Heavy chain CDR3 for antibody 11363 (IGHV3-33)
ARELAYFDY

SEQ ID NO: 22727 - protein, 9 aa, Homo sapiens
  Light chain CDR3 for antibody 11364 (IGKV1-9)
QQLNSYPLT

SEQ ID NO: 22728 - protein, 13 aa, Homo sapiens
  Heavy chain CDR3 for antibody 11364 (IGHV4-59)
ASDAGYSSCCFDY

SEQ ID NO: 22729 - protein, 8 aa, Homo sapiens
  Light chain CDR3 for antibody 11365 (IGKV6-21)
HQSSSLPT

SEQ ID NO: 22730 - protein, 14 aa, Homo sapiens
  Heavy chain CDR3 for antibody 11365 (IGHV3-20)
ARDGGSTCYDWFDP

SEQ ID NO: 22731 - protein, 9 aa, Homo sapiens
  Light chain CDR3 for antibody 11366 (IGKV3-20)
QQYNSYPYT

SEQ ID NO: 22732 - protein, 16 aa, Homo sapiens
  Heavy chain CDR3 for antibody 11366 (IGHV3-66)
ARESLKLGIYYYGMDV

SEQ ID NO: 22733 - protein, 9 aa, Homo sapiens
  Light chain CDR3 for antibody 11367 (IGKV1-6)
LQVYSYPWT

SEQ ID NO: 22734 - protein, 11 aa, Homo sapiens
  Heavy chain CDR3 for antibody 11367 (IGHV3-33)
ARDKSSGWSDY

SEQ ID NO: 22735 - protein, 9 aa, Homo sapiens
  Light chain CDR3 for antibody 11368 (IGKV1-9)
QQLKSYPYT

SEQ ID NO: 22736 - protein, 15 aa, Homo sapiens
  Heavy chain CDR3 for antibody 11368 (IGHV3-33)
ARDTGYSSSWNWFDP

SEQ ID NO: 22737 - protein, 9 aa, Homo sapiens
  Light chain CDR3 for antibody 11369 (IGKV1-6)
LQDFHYPWT

SEQ ID NO: 22738 - protein, 10 aa, Homo sapiens
  Heavy chain CDR3 for antibody 11369 (IGHV3-33)
ARDGSGSQPI

SEQ ID NO: 22739 - protein, 10 aa, Homo sapiens
  Light chain CDR3 for antibody 11370 (IGKV3-15)
QQYNNWPPYT

SEQ ID NO: 22740 - protein, 18 aa, Homo sapiens
  Heavy chain CDR3 for antibody 11370 (IGHV3-33)
ARGLLWFGVSYYYYGMDV

SEQ ID NO: 22741 - protein, 9 aa, Homo sapiens
  Light chain CDR3 for antibody 11371 (IGKV3-11)
QQRSSWPPT

SEQ ID NO: 22742 - protein, 15 aa, Homo sapiens
  Heavy chain CDR3 for antibody 11371 (IGHV3-33)
ARDSRPEITGPPFDY

SEQ ID NO: 22743 - protein, 9 aa, Homo sapiens
  Light chain CDR3 for antibody 11372 (IGKV1D-13)
QHFNNYMYT

SEQ ID NO: 22744 - protein, 20 aa, Homo sapiens
  Heavy chain CDR3 for antibody 11372 (IGHV3-33)
AKDREMAATSHYYYYYGMDV

SEQ ID NO: 22745 - protein, 8 aa, Homo sapiens
  Light chain CDR3 for antibody 11373 (IGKV1-5)
QQYNSYYT

SEQ ID NO: 22746 - protein, 15 aa, Homo sapiens
  Heavy chain CDR3 for antibody 11373 (IGHV3-33)
ARDGSGSYSLYGMDV

SEQ ID NO: 22747 - protein, 9 aa, Homo sapiens
  Light chain CDR3 for antibody 11374 (IGKV4-1)
QQYYTTPPT

SEQ ID NO: 22748 - protein, 20 aa, Homo sapiens
  Heavy chain CDR3 for antibody 11374 (IGHV3-11)
ARGGATLIRGLIDYYYGMDV

SEQ ID NO: 22749 - protein, 9 aa, Homo sapiens
  Light chain CDR3 for antibody 11375 (IGKV1-17)
LHSNNYPWT

SEQ ID NO: 22750 - protein, 17 aa, Homo sapiens
  Heavy chain CDR3 for antibody 11375 (IGHV1-18)
ARERYYGSGIYKYAMDV

SEQ ID NO: 22751 - protein, 8 aa, Homo sapiens
  Light chain CDR3 for antibody 11376 (IGKV3-11)
QQRSNWLT

SEQ ID NO: 22752 - protein, 13 aa, Homo sapiens
  Heavy chain CDR3 for antibody 11376 (IGHV4-39)
ARHEVMIRGVFDY

SEQ ID NO: 22753 - protein, 9 aa, Homo sapiens
  Light chain CDR3 for antibody 11377 (IGKV1-9)
QQYNSYPRT

SEQ ID NO: 22754 - protein, 15 aa, Homo sapiens
  Heavy chain CDR3 for antibody 11377 (IGHV3-33)
ARRGGIAAAGYYFDY

SEQ ID NO: 22755 - protein, 9 aa, Homo sapiens
  Light chain CDR3 for antibody 11378 (IGKV1-17)
LQHNSYPYT

SEQ ID NO: 22756 - protein, 10 aa, Homo sapiens
  Heavy chain CDR3 for antibody 11378 (IGHV3-13)
ARDRGSYYDY

SEQ ID NO: 22757 - protein, 8 aa, Homo sapiens
  Light chain CDR3 for antibody 11379 (IGKV3-20)
QQYGSSRT

SEQ ID NO: 22758 - protein, 10 aa, Homo sapiens
  Heavy chain CDR3 for antibody 11379 (IGHV3-33)
ARDLGWSFDH

SEQ ID NO: 22759 - protein, 9 aa, Homo sapiens
  Light chain CDR3 for antibody 11380 (IGKV1-6)
LQAYNYPYT

SEQ ID NO: 22760 - protein, 20 aa, Homo sapiens
  Heavy chain CDR3 for antibody 11380 (IGHV3-20)
ARDSCSSTSCYGYYYYGMDV

SEQ ID NO: 22761 - protein, 9 aa, Homo sapiens
  Light chain CDR3 for antibody 11381 (IGKV2D-28)
MQALQTPPT

SEQ ID NO: 22762 - protein, 9 aa, Homo sapiens
  Heavy chain CDR3 for antibody 11381 (IGHV3-30)
ARDNWGFDY

SEQ ID NO: 22763 - protein, 9 aa, Homo sapiens
  Light chain CDR3 for antibody 11382 (IGKV1-27)
QKYNSAPYT

SEQ ID NO: 22764 - protein, 16 aa, Homo sapiens
  Heavy chain CDR3 for antibody 11382 (IGHV3-33)
ARGANYYGSGIHNFEY

SEQ ID NO: 22765 - protein, 9 aa, Homo sapiens
  Light chain CDR3 for antibody 11383 (IGKV1-6)
LQGYNYPRS

SEQ ID NO: 22766 - protein, 13 aa, Homo sapiens
  Heavy chain CDR3 for antibody 11383 (IGHV3-33)
ARDYCGGDCYLDY

SEQ ID NO: 22767 - protein, 9 aa, Homo sapiens
  Light chain CDR3 for antibody 11384 (IGKV1-17)
LQHNSYPRT

SEQ ID NO: 22768 - protein, 10 aa, Homo sapiens
  Heavy chain CDR3 for antibody 11384 (IGHV3-72)
CRDREGFGDV

SEQ ID NO: 22769 - protein, 9 aa, Homo sapiens
  Light chain CDR3 for antibody 11385 (IGKV1D-13)
QRFNNYLYT

SEQ ID NO: 22770 - protein, 11 aa, Homo sapiens
  Heavy chain CDR3 for antibody 11385 (IGHV3-33)
ARDILTGFLDH

SEQ ID NO: 22771 - protein, 9 aa, Homo sapiens
  Light chain CDR3 for antibody 11386 (IGKV1-27)
QKYNSAPYT

SEQ ID NO: 22772 - protein, 16 aa, Homo sapiens
  Heavy chain CDR3 for antibody 11386 (IGHV3-30)
ARDSSYYGSGYYGMDV

SEQ ID NO: 22773 - protein, 9 aa, Homo sapiens
  Light chain CDR3 for antibody 11387 (IGKV1-9)
QQLHIYPWT

SEQ ID NO: 22774 - protein, 14 aa, Homo sapiens
  Heavy chain CDR3 for antibody 11387 (IGHV3-33)
ARDGYDFLTGPFDY

SEQ ID NO: 22775 - protein, 9 aa, Homo sapiens
  Light chain CDR3 for antibody 11388 (IGKV1-39)
QQSYRTPLT

SEQ ID NO: 22776 - protein, 14 aa, Homo sapiens
  Heavy chain CDR3 for antibody 11388 (IGHV3-11)
ARDRGRHNYFGMDV

SEQ ID NO: 22777 - protein, 9 aa, Homo sapiens
  Light chain CDR3 for antibody 11389 (IGKV1-9)
QQLNSYPYT

SEQ ID NO: 22778 - protein, 10 aa, Homo sapiens
  Heavy chain CDR3 for antibody 11389 (IGHV1-8)
AKEQWLAPDY

SEQ ID NO: 22779 - protein, 9 aa, Homo sapiens
  Light chain CDR3 for antibody 11390 (IGKV3-20)
QQYGSSPYT

SEQ ID NO: 22780 - protein, 9 aa, Homo sapiens
  Heavy chain CDR3 for antibody 11390 (IGHV3-30)
VRDDYGVDV

SEQ ID NO: 22781 - protein, 9 aa, Homo sapiens
  Light chain CDR3 for antibody 11391 (IGKV3-11)
QQRSSWPPT

SEQ ID NO: 22782 - protein, 12 aa, Homo sapiens
  Heavy chain CDR3 for antibody 11391 (IGHV4-39)
ARHGSGSSYFDY

SEQ ID NO: 22783 - protein, 8 aa, Homo sapiens
  Light chain CDR3 for antibody 11392 (IGKV6-21)
HQSSSLYT

SEQ ID NO: 22784 - protein, 11 aa, Homo sapiens
  Heavy chain CDR3 for antibody 11392 (IGHV4-4)
AREAYYYGLDV

SEQ ID NO: 22785 - protein, 9 aa, Homo sapiens
  Light chain CDR3 for antibody 11393 (IGKV3-11)
QQRSNWQYT

SEQ ID NO: 22786 - protein, 15 aa, Homo sapiens
  Heavy chain CDR3 for antibody 11393 (IGHV3-23)
AKDRYFDWLSDAFDI

SEQ ID NO: 22787 - protein, 8 aa, Homo sapiens
  Light chain CDR3 for antibody 11394 (IGKV1D-13)
QQFNNYYT

SEQ ID NO: 22788 - protein, 15 aa, Homo sapiens
  Heavy chain CDR3 for antibody 11394 (IGHV1-69)
ARGAVDDYYYYGMDV

SEQ ID NO: 22789 - protein, 9 aa, Homo sapiens
  Light chain CDR3 for antibody 11395 (IGKV1-6)
LQDYNYPYT

SEQ ID NO: 22790 - protein, 16 aa, Homo sapiens
  Heavy chain CDR3 for antibody 11395 (IGHV3-33)
ARGYEMLTGDYHGMDV

SEQ ID NO: 22791 - protein, 9 aa, Homo sapiens
  Light chain CDR3 for antibody 11396 (IGKV1-17)
LQQYSYPWT

SEQ ID NO: 22792 - protein, 13 aa, Homo sapiens
  Heavy chain CDR3 for antibody 11396 (IGHV4-28)
ARKGATGYYGMDV

SEQ ID NO: 22793 - protein, 8 aa, Homo sapiens
  Light chain CDR3 for antibody 11397 (IGKV1D-13)
QQFNNYYT

SEQ ID NO: 22794 - protein, 11 aa, Homo sapiens
  Heavy chain CDR3 for antibody 11397 (IGHV4-59)
TRDRGLGSFDY

SEQ ID NO: 22795 - protein, 8 aa, Homo sapiens
  Light chain CDR3 for antibody 11398 (IGKV3-11)
LQRGNWPT

SEQ ID NO: 22796 - protein, 14 aa, Homo sapiens
  Heavy chain CDR3 for antibody 11398 (IGHV3-15)
ARDKTYPLSYGMDV

SEQ ID NO: 22797 - protein, 9 aa, Homo sapiens
  Light chain CDR3 for antibody 11399 (IGKV1D-13)
QQFNNYPYT

SEQ ID NO: 22798 - protein, 14 aa, Homo sapiens
  Heavy chain CDR3 for antibody 11399 (IGHV3-23)
AKDDIVRATGAFDI

SEQ ID NO: 22799 - protein, 9 aa, Homo sapiens
  Light chain CDR3 for antibody 11400 (IGKV3D-7)
QQDYEFPLT

SEQ ID NO: 22800 - protein, 11 aa, Homo sapiens
  Heavy chain CDR3 for antibody 11400 (IGHV3-74)
ARDRGNWGFDY

SEQ ID NO: 22801 - protein, 9 aa, Homo sapiens
  Light chain CDR3 for antibody 11401 (IGKV1D-16)
QQHNSYPYT

SEQ ID NO: 22802 - protein, 10 aa, Homo sapiens
  Heavy chain CDR3 for antibody 11401 (IGHV3-74)
ARADWGGFDY

SEQ ID NO: 22803 - protein, 9 aa, Homo sapiens
  Light chain CDR3 for antibody 11402 (IGKV2D-28)
MQALQTPPT

SEQ ID NO: 22804 - protein, 10 aa, Homo sapiens
  Heavy chain CDR3 for antibody 11402 (IGHV3-74)
ARENWGGFDY

SEQ ID NO: 22805 - protein, 9 aa, Homo sapiens
  Light chain CDR3 for antibody 11403 (IGKV1-39)
QQSYRTPLT

SEQ ID NO: 22806 - protein, 16 aa, Homo sapiens
  Heavy chain CDR3 for antibody 11403 (IGHV1-24)
ATDWNDRGYYYYGMDV

SEQ ID NO: 22807 - protein, 9 aa, Homo sapiens
  Light chain CDR3 for antibody 11404 (IGKV3D-7)
QQDYNLPYT

SEQ ID NO: 22808 - protein, 14 aa, Homo sapiens
  Heavy chain CDR3 for antibody 11404 (IGHV3-74)
ARDAYDILTGYYDY

SEQ ID NO: 22809 - protein, 10 aa, Homo sapiens
  Light chain CDR3 for antibody 11405 (IGKV3-11)
QQRSNWPIYT

SEQ ID NO: 22810 - protein, 17 aa, Homo sapiens
  Heavy chain CDR3 for antibody 11405 (IGHV3-33)
ARDSYDILTGYYKPFDY

SEQ ID NO: 22811 - protein, 11 aa, Homo sapiens
  Light chain CDR3 for antibody 11406 (IGKV3-11)
QQRSNWPPTWT

SEQ ID NO: 22812 - protein, 13 aa, Homo sapiens
  Heavy chain CDR3 for antibody 11406 (IGHV3-23)
AKDRGGSYSYFDF

SEQ ID NO: 22813 - protein, 9 aa, Homo sapiens
  Light chain CDR3 for antibody 11407 (IGKV2D-28)
MQALQTPPT

SEQ ID NO: 22814 - protein, 14 aa, Homo sapiens
  Heavy chain CDR3 for antibody 11407 (IGHV3-15)
SIYYYGSGRDFFDY

SEQ ID NO: 22815 - protein, 9 aa, Homo sapiens
  Light chain CDR3 for antibody 11408 (IGKV1-17)
LQHDSFPWT

SEQ ID NO: 22816 - protein, 19 aa, Homo sapiens
  Heavy chain CDR3 for antibody 11408 (IGHV3-20)
ARDLCSSTSCYGYYYGMDV

SEQ ID NO: 22817 - protein, 9 aa, Homo sapiens
  Light chain CDR3 for antibody 11409 (IGKV1D-16)
QQYNSYPYT

SEQ ID NO: 22818 - protein, 18 aa, Homo sapiens
  Heavy chain CDR3 for antibody 11409 (IGHV3-23)
AKDRITGTTYGYYAGLDV

SEQ ID NO: 22819 - protein, 9 aa, Homo sapiens
  Light chain CDR3 for antibody 11410 (IGKV1D-16)
QQYHSYPYT

SEQ ID NO: 22820 - protein, 20 aa, Homo sapiens
  Heavy chain CDR3 for antibody 11410 (IGHV3-33)
ARDPAQMERRYYYFYYGMDV

SEQ ID NO: 22821 - protein, 8 aa, Homo sapiens
  Light chain CDR3 for antibody 11411 (IGKV1-5)
QQYNSYWT

SEQ ID NO: 22822 - protein, 18 aa, Homo sapiens
  Heavy chain CDR3 for antibody 11411 (IGHV3-33)
ARDHYDILTGYYKGWFDP

SEQ ID NO: 22823 - protein, 9 aa, Homo sapiens
  Light chain CDR3 for antibody 11412 (IGKV3-15)
QQYNNWPRT

SEQ ID NO: 22824 - protein, 14 aa, Homo sapiens
  Heavy chain CDR3 for antibody 11412 (IGHV3-33)
ARDTVAAGFNGMDV

SEQ ID NO: 22825 - protein, 8 aa, Homo sapiens
  Light chain CDR3 for antibody 11413 (IGKV1-5)
QQYNSYYT

SEQ ID NO: 22826 - protein, 17 aa, Homo sapiens
  Heavy chain CDR3 for antibody 11413 (IGHV3-33)
ARSYYDILTGYSYYFDY

SEQ ID NO: 22827 - protein, 8 aa, Homo sapiens
  Light chain CDR3 for antibody 11414 (IGKV1-5)
QQYNSYYT

SEQ ID NO: 22828 - protein, 17 aa, Homo sapiens
  Heavy chain CDR3 for antibody 11414 (IGHV3-33)
ARCGYSSSWYDPYYFDY

SEQ ID NO: 22829 - protein, 9 aa, Homo sapiens
  Light chain CDR3 for antibody 11415 (IGKV1-17)
LQHNSFPLT

SEQ ID NO: 22830 - protein, 9 aa, Homo sapiens
  Heavy chain CDR3 for antibody 11415 (IGHV3-30)
ARPNWGFDY

SEQ ID NO: 22831 - protein, 11 aa, Homo sapiens
  Light chain CDR3 for antibody 11416 (IGKV3-11)
QQRSNWPPTWT

SEQ ID NO: 22832 - protein, 17 aa, Homo sapiens
  Heavy chain CDR3 for antibody 11416 (IGHV4-39)
ARVLRYFDWLSHDAFDI

SEQ ID NO: 22833 - protein, 9 aa, Homo sapiens
  Light chain CDR3 for antibody 11417 (IGKV1-6)
LQDYNYPWT

SEQ ID NO: 22834 - protein, 15 aa, Homo sapiens
  Heavy chain CDR3 for antibody 11417 (IGHV4-59)
ARYLGHYYGSVSIDY

SEQ ID NO: 22835 - protein, 9 aa, Homo sapiens
  Light chain CDR3 for antibody 11418 (IGKV3-15)
QQYHNWPLT

SEQ ID NO: 22836 - protein, 15 aa, Homo sapiens
  Heavy chain CDR3 for antibody 11418 (IGHV3-23)
AKEFTMVRGVITPDY

SEQ ID NO: 22837 - protein, 9 aa, Homo sapiens
  Light chain CDR3 for antibody 11419 (IGKV1-9)
QQLISYPLT

SEQ ID NO: 22838 - protein, 18 aa, Homo sapiens
  Heavy chain CDR3 for antibody 11419 (IGHV3-33)
ARDYDSLTTYPEDYGMEV

SEQ ID NO: 22839 - protein, 9 aa, Homo sapiens
  Light chain CDR3 for antibody 11420 (IGKV1-27)
QKYNSAPYT

SEQ ID NO: 22840 - protein, 20 aa, Homo sapiens
  Heavy chain CDR3 for antibody 11420 (IGHV3-53)
ATHYDILTGSPYYYYCALDV

SEQ ID NO: 22841 - protein, 9 aa, Homo sapiens
  Light chain CDR3 for antibody 11421 (IGKV1-6)
LQDYKSPFT

SEQ ID NO: 22842 - protein, 17 aa, Homo sapiens
  Heavy chain CDR3 for antibody 11421 (IGHV4-39)
ARQGWYYGSGSSLLFDY

SEQ ID NO: 22843 - protein, 9 aa, Homo sapiens
  Light chain CDR3 for antibody 11422 (IGKV1-9)
QQVKGYPYT

SEQ ID NO: 22844 - protein, 18 aa, Homo sapiens
  Heavy chain CDR3 for antibody 11422 (IGHV1-46)
AREGDYVWGSYRPNWFDP

SEQ ID NO: 22845 - protein, 9 aa, Homo sapiens
  Light chain CDR3 for antibody 11423 (IGKV1-6)
LQDFHYPWT

SEQ ID NO: 22846 - protein, 12 aa, Homo sapiens
  Heavy chain CDR3 for antibody 11423 (IGHV1-46)
ARGLTGDHASDI

SEQ ID NO: 22847 - protein, 9 aa, Homo sapiens
  Light chain CDR3 for antibody 11424 (IGKV5-2)
LQHDKFPYT

SEQ ID NO: 22848 - protein, 9 aa, Homo sapiens
  Heavy chain CDR3 for antibody 11424 (IGHV3-30)
ARPNWGFDY

SEQ ID NO: 22849 - protein, 9 aa, Homo sapiens
  Light chain CDR3 for antibody 11425 (IGKV3-20)
QQYGSSPYT

SEQ ID NO: 22850 - protein, 9 aa, Homo sapiens
  Heavy chain CDR3 for antibody 11425 (IGHV3-74)
ARSEYQPTY

SEQ ID NO: 22851 - protein, 10 aa, Homo sapiens
  Light chain CDR3 for antibody 11426 (IGKV3-11)
QQRSNWLMYT

SEQ ID NO: 22852 - protein, 17 aa, Homo sapiens
  Heavy chain CDR3 for antibody 11426 (IGHV3-33)
ARGFSGYDGYYYYGMDV

SEQ ID NO: 22853 - protein, 10 aa, Homo sapiens
  Light chain CDR3 for antibody 11427 (IGKV3-11)
QQRSNWPIFT

SEQ ID NO: 22854 - protein, 10 aa, Homo sapiens
  Heavy chain CDR3 for antibody 11427 (IGHV4-39)
ARQLGNWFDP

SEQ ID NO: 22855 - protein, 9 aa, Homo sapiens
  Light chain CDR3 for antibody 11428 (IGKV1D-13)
QRFNNYLYT

SEQ ID NO: 22856 - protein, 20 aa, Homo sapiens
  Heavy chain CDR3 for antibody 11428 (IGHV1-f)
ATGLITFVRGVILTYRSFDY

SEQ ID NO: 22857 - protein, 10 aa, Homo sapiens
  Light chain CDR3 for antibody 11429 (IGKV3-15)
QQYNNWPPYT

SEQ ID NO: 22858 - protein, 15 aa, Homo sapiens
  Heavy chain CDR3 for antibody 11429 (IGHV3-33)
ARDGLRYFDWLFPWY

SEQ ID NO: 22859 - protein, 9 aa, Homo sapiens
  Light chain CDR3 for antibody 11430 (IGKV3-15)
QQYHNWPLT

SEQ ID NO: 22860 - protein, 18 aa, Homo sapiens
  Heavy chain CDR3 for antibody 11430 (IGHV3-33)
ARGLLWFGVSYYYYGMDV

SEQ ID NO: 22861 - protein, 9 aa, Homo sapiens
  Light chain CDR3 for antibody 11431 (IGKV1-17)
IQHNTYPYT

SEQ ID NO: 22862 - protein, 18 aa, Homo sapiens
  Heavy chain CDR3 for antibody 11431 (IGHV4-59)
AREGDYVWGSYRPNCFDP

SEQ ID NO: 22863 - protein, 10 aa, Homo sapiens
  Light chain CDR3 for antibody 11432 (IGKV3-20)
QQYGRSPPVT

SEQ ID NO: 22864 - protein, 14 aa, Homo sapiens
  Heavy chain CDR3 for antibody 11432 (IGHV3-33)
ARDRIAAASSDFDC

SEQ ID NO: 22865 - protein, 9 aa, Homo sapiens
  Light chain CDR3 for antibody 11433 (IGKV1-6)
LQDFHYPWT

SEQ ID NO: 22866 - protein, 13 aa, Homo sapiens
  Heavy chain CDR3 for antibody 11433 (IGHV3-33)
ASGYSGYDWYFDL

SEQ ID NO: 22867 - protein, 8 aa, Homo sapiens
  Light chain CDR3 for antibody 11434 (IGKV3D-7)
QQDYNLLT

SEQ ID NO: 22868 - protein, 11 aa, Homo sapiens
  Heavy chain CDR3 for antibody 11434 (IGHV3-33)
ARDRSTGWLDY

SEQ ID NO: 22869 - protein, 9 aa, Homo sapiens
  Light chain CDR3 for antibody 11435 (IGKV2-30)
MQGTHWPLT

SEQ ID NO: 22870 - protein, 10 aa, Homo sapiens
  Heavy chain CDR3 for antibody 11435 (IGHV3-23)
ATIVGPFLDV

SEQ ID NO: 22871 - protein, 9 aa, Homo sapiens
  Light chain CDR3 for antibody 11436 (IGKV1D-13)
QQFNNYPYT

SEQ ID NO: 22872 - protein, 13 aa, Homo sapiens
  Heavy chain CDR3 for antibody 11436 (IGHV3-33)
GRTDYYSYYGVDV

SEQ ID NO: 22873 - protein, 9 aa, Homo sapiens
  Light chain CDR3 for antibody 11437 (IGKV3-15)
QQYNNWPYT

SEQ ID NO: 22874 - protein, 8 aa, Homo sapiens
  Heavy chain CDR3 for antibody 11437 (IGHV3-23)
AETFLFDY

SEQ ID NO: 22875 - protein, 8 aa, Homo sapiens
  Light chain CDR3 for antibody 11438 (IGKV3-11)
QQRSNWLT

SEQ ID NO: 22876 - protein, 14 aa, Homo sapiens
  Heavy chain CDR3 for antibody 11438 (IGHV3-15)
SIYFYGSGRDYFDY

SEQ ID NO: 22877 - protein, 10 aa, Homo sapiens
  Light chain CDR3 for antibody 11439 (IGKV1-17)
LQHNSYPMYT

SEQ ID NO: 22878 - protein, 11 aa, Homo sapiens
  Heavy chain CDR3 for antibody 11439 (IGHV3-33)
ARARYTTGLDY

SEQ ID NO: 22879 - protein, 10 aa, Homo sapiens
  Light chain CDR3 for antibody 11440 (IGKV3-15)
QQYNNWPPIT

SEQ ID NO: 22880 - protein, 13 aa, Homo sapiens
  Heavy chain CDR3 for antibody 11440 (IGHV4-39)
ARRGVVAPAAFDY

SEQ ID NO: 22881 - protein, 10 aa, Homo sapiens
  Light chain CDR3 for antibody 11441 (IGKV1-27)
QKYNSAPMYT

SEQ ID NO: 22882 - protein, 12 aa, Homo sapiens
  Heavy chain CDR3 for antibody 11441 (IGHV3-33)
ARGYFGSGYAHF

SEQ ID NO: 22883 - protein, 9 aa, Homo sapiens
  Light chain CDR3 for antibody 11442 (IGKV1-6)
QQEYNYPLT

SEQ ID NO: 22884 - protein, 12 aa, Homo sapiens
  Heavy chain CDR3 for antibody 11442 (IGHV1-46)
AREDYDIDGMDV

SEQ ID NO: 22885 - protein, 8 aa, Homo sapiens
  Light chain CDR3 for antibody 11443 (IGKV1D-13)
QQFNNYPT

SEQ ID NO: 22886 - protein, 14 aa, Homo sapiens
  Heavy chain CDR3 for antibody 11443 (IGHV3-33)
ARQYSYGYPYYFDY

SEQ ID NO: 22887 - protein, 8 aa, Homo sapiens
  Light chain CDR3 for antibody 11444 (IGKV3D-7)
QQDYNLVT

SEQ ID NO: 22888 - protein, 18 aa, Homo sapiens
  Heavy chain CDR3 for antibody 11444 (IGHV4-59)
ARRITMVRGEGSYYGMDV

SEQ ID NO: 22889 - protein, 9 aa, Homo sapiens
  Light chain CDR3 for antibody 11445 (IGKV3-20)
QQFGRSPRT

SEQ ID NO: 22890 - protein, 15 aa, Homo sapiens
  Heavy chain CDR3 for antibody 11445 (IGHV1-18)
ARGYCSSTSCYYFDY

SEQ ID NO: 22891 - protein, 9 aa, Homo sapiens
  Light chain CDR3 for antibody 11446 (IGKV2D-28)
MQVLQTPFT

SEQ ID NO: 22892 - protein, 19 aa, Homo sapiens
  Heavy chain CDR3 for antibody 11446 (IGHV4-59)
ARDRVVGATTYYYYYGMDV

SEQ ID NO: 22893 - protein, 9 aa, Homo sapiens
  Light chain CDR3 for antibody 11447 (IGKV1-6)
LQDFHYPWT

SEQ ID NO: 22894 - protein, 12 aa, Homo sapiens
  Heavy chain CDR3 for antibody 11447 (IGHV4-39)
ARHGSGSSYFDY

SEQ ID NO: 22895 - protein, 10 aa, Homo sapiens
  Light chain CDR3 for antibody 11448 (IGKV3-11)
QQRSIWPPYT

SEQ ID NO: 22896 - protein, 14 aa, Homo sapiens
  Heavy chain CDR3 for antibody 11448 (IGHV3-23)
AKSRIVGALYYFDY

SEQ ID NO: 22897 - protein, 7 aa, Homo sapiens
  Light chain CDR3 for antibody 11449 (IGKV3-11)
QQRSKFT

SEQ ID NO: 22898 - protein, 12 aa, Homo sapiens
  Heavy chain CDR3 for antibody 11449 (IGHV1-18)
ARILFYGDYFDY

SEQ ID NO: 22899 - protein, 9 aa, Homo sapiens
  Light chain CDR3 for antibody 11450 (IGKV1-6)
LQYYNYPRT

SEQ ID NO: 22900 - protein, 14 aa, Homo sapiens
  Heavy chain CDR3 for antibody 11450 (IGHV3-33)
ARASSGSSYWYCDL

SEQ ID NO: 22901 - protein, 8 aa, Homo sapiens
  Light chain CDR3 for antibody 11451 (IGKV3-20)
QQYGSSLT

SEQ ID NO: 22902 - protein, 19 aa, Homo sapiens
  Heavy chain CDR3 for antibody 11451 (IGHV3-33)
ARDRYYDILTGYSSYYFDY

SEQ ID NO: 22903 - protein, 9 aa, Homo sapiens
  Light chain CDR3 for antibody 11452 (IGKV3D-7)
QQDYKLPLT

SEQ ID NO: 22904 - protein, 11 aa, Homo sapiens
  Heavy chain CDR3 for antibody 11452 (IGHV1-24)
ATELGLYYFDY

SEQ ID NO: 22905 - protein, 9 aa, Homo sapiens
  Light chain CDR3 for antibody 11453 (IGKV1-39)
QQSYSTPFT

SEQ ID NO: 22906 - protein, 23 aa, Homo sapiens
  Heavy chain CDR3 for antibody 11453 (IGHV4-59)
ARERTYSGILPGYYEDYYYGMDV

SEQ ID NO: 22907 - protein, 9 aa, Homo sapiens
  Light chain CDR3 for antibody 11454 (IGKV1D-13)
QQFNNYPYT

SEQ ID NO: 22908 - protein, 17 aa, Homo sapiens
  Heavy chain CDR3 for antibody 11454 (IGHV3-33)
AREGYYYGSGSYYTFDY

SEQ ID NO: 22909 - protein, 9 aa, Homo sapiens
  Light chain CDR3 for antibody 11455 (IGKV1-16)
QQYNSYPYT

SEQ ID NO: 22910 - protein, 13 aa, Homo sapiens
  Heavy chain CDR3 for antibody 11455 (IGHV4-39)
ARRDVLAPAAFEY

SEQ ID NO: 22911 - protein, 9 aa, Homo sapiens
  Light chain CDR3 for antibody 11456 (IGKV1-39)
QQSYSTPYT

SEQ ID NO: 22912 - protein, 13 aa, Homo sapiens
  Heavy chain CDR3 for antibody 11456 (IGHV3-33)
ARGRGYNYGYGDY

SEQ ID NO: 22913 - protein, 9 aa, Homo sapiens
  Light chain CDR3 for antibody 11457 (IGKV1-6)
LQDYNYPRT

SEQ ID NO: 22914 - protein, 16 aa, Homo sapiens
  Heavy chain CDR3 for antibody 11457 (IGHV3-33)
AREGDILTGYYWYFDL

SEQ ID NO: 22915 - protein, 9 aa, Homo sapiens
  Light chain CDR3 for antibody 11458 (IGKV1-17)
LHSNNYPWT

SEQ ID NO: 22916 - protein, 17 aa, Homo sapiens
  Heavy chain CDR3 for antibody 11458 (IGHV3-33)
ARGGAAAGPYLYYGLDV

SEQ ID NO: 22917 - protein, 9 aa, Homo sapiens
  Light chain CDR3 for antibody 11459 (IGKV1-9)
QQLISYPLT

SEQ ID NO: 22918 - protein, 16 aa, Homo sapiens
  Heavy chain CDR3 for antibody 11459 (IGHV3-23)
ARNWNDVGDYYYGMDV

SEQ ID NO: 22919 - protein, 9 aa, Homo sapiens
  Light chain CDR3 for antibody 11460 (IGKV1-9)
QQLISYPLT

SEQ ID NO: 22920 - protein, 18 aa, Homo sapiens
  Heavy chain CDR3 for antibody 11460 (IGHV3-30)
ARDRHHDILTGYSDAFEI

SEQ ID NO: 22921 - protein, 9 aa, Homo sapiens
  Light chain CDR3 for antibody 11461 (IGKV1-6)
LQVYSYPWT

SEQ ID NO: 22922 - protein, 20 aa, Homo sapiens
  Heavy chain CDR3 for antibody 11461 (IGHV3-20)
ARDRCSSTSCYGYYYYGMDV

SEQ ID NO: 22923 - protein, 9 aa, Homo sapiens
  Light chain CDR3 for antibody 11462 (IGKV1D-16)
QQYNSYPFT

SEQ ID NO: 22924 - protein, 16 aa, Homo sapiens
  Heavy chain CDR3 for antibody 11462 (IGHV3-33)
ARDYYDSSGYWGHFDY

SEQ ID NO: 22925 - protein, 8 aa, Homo sapiens
  Light chain CDR3 for antibody 11463 (IGKV1-5)
QQYNSYYT

SEQ ID NO: 22926 - protein, 18 aa, Homo sapiens
  Heavy chain CDR3 for antibody 11463 (IGHV3-23)
ARYHLYFGSGFGSDGMDV

SEQ ID NO: 22927 - protein, 8 aa, Homo sapiens
  Light chain CDR3 for antibody 11464 (IGKV3-20)
QQYGSSLT

SEQ ID NO: 22928 - protein, 18 aa, Homo sapiens
  Heavy chain CDR3 for antibody 11464 (IGHV1-8)
ARSRIAAAGIYYYYGMDV

SEQ ID NO: 22929 - protein, 9 aa, Homo sapiens
  Light chain CDR3 for antibody 11465 (IGKV1-27)
QKYNSAPYT

SEQ ID NO: 22930 - protein, 11 aa, Homo sapiens
  Heavy chain CDR3 for antibody 11465 (IGHV1-46)
AREEDLGAFDI

SEQ ID NO: 22931 - protein, 9 aa, Homo sapiens
  Light chain CDR3 for antibody 11466 (IGKV1-27)
QKYNSAPYT

SEQ ID NO: 22932 - protein, 13 aa, Homo sapiens
  Heavy chain CDR3 for antibody 11466 (IGHV1-18)
ARSITMVRGVIGY

SEQ ID NO: 22933 - protein, 9 aa, Homo sapiens
  Light chain CDR3 for antibody 11467 (IGKV1-6)
LQDYNYPYT

SEQ ID NO: 22934 - protein, 17 aa, Homo sapiens
  Heavy chain CDR3 for antibody 11467 (IGHV3-33)
AREGYYYGSRSYHFFDY

SEQ ID NO: 22935 - protein, 9 aa, Homo sapiens
  Light chain CDR3 for antibody 11468 (IGKV3D-7)
QQDYKLPRT

SEQ ID NO: 22936 - protein, 13 aa, Homo sapiens
  Heavy chain CDR3 for antibody 11468 (IGHV1-18)
ARKWEWDLLNFDY

SEQ ID NO: 22937 - protein, 9 aa, Homo sapiens
  Light chain CDR3 for antibody 11469 (IGKV1D-13)
QQFNNYPYT

SEQ ID NO: 22938 - protein, 17 aa, Homo sapiens
  Heavy chain CDR3 for antibody 11469 (IGHV3-23)
AKERNWNDGYYYYGMDV

SEQ ID NO: 22939 - protein, 10 aa, Homo sapiens
  Light chain CDR3 for antibody 11470 (IGKV3-11)
QQRSNWPIFT

SEQ ID NO: 22940 - protein, 10 aa, Homo sapiens
  Heavy chain CDR3 for antibody 11470 (IGHV3-33)
ARDLGWSFDH

SEQ ID NO: 22941 - protein, 9 aa, Homo sapiens
  Light chain CDR3 for antibody 11471 (IGKV1-6)
LQDFHYPWT

SEQ ID NO: 22942 - protein, 15 aa, Homo sapiens
  Heavy chain CDR3 for antibody 11471 (IGHV3-23)
AKDGSYYYYYYGMDV

SEQ ID NO: 22943 - protein, 9 aa, Homo sapiens
  Light chain CDR3 for antibody 11472 (IGKV4-1)
QQYYSTPWT

SEQ ID NO: 22944 - protein, 18 aa, Homo sapiens
  Heavy chain CDR3 for antibody 11472 (IGHV3-30)
ARDRHHDILTGYSDAFEI

SEQ ID NO: 22945 - protein, 9 aa, Homo sapiens
  Light chain CDR3 for antibody 11473 (IGKV1D-13)
QQFNNYPYT

SEQ ID NO: 22946 - protein, 9 aa, Homo sapiens
  Heavy chain CDR3 for antibody 11473 (IGHV3-33)
ARELAYFDY

SEQ ID NO: 22947 - protein, 9 aa, Homo sapiens
  Light chain CDR3 for antibody 11474 (IGKV3D-7)
QQDYTLPLT

SEQ ID NO: 22948 - protein, 20 aa, Homo sapiens
  Heavy chain CDR3 for antibody 11474 (IGHV3-33)
ARDNDSSGYYDYYYYYGMDV

SEQ ID NO: 22949 - protein, 9 aa, Homo sapiens
  Light chain CDR3 for antibody 11475 (IGKV4-1)
QQYYSTPRT

SEQ ID NO: 22950 - protein, 18 aa, Homo sapiens
  Heavy chain CDR3 for antibody 11475 (IGHV3-33)
ARGLLWFGVSYYYYGMDV

SEQ ID NO: 22951 - protein, 11 aa, Homo sapiens
  Light chain CDR3 for antibody 11476 (IGKV3-11)
QQRSNWPPTWT

SEQ ID NO: 22952 - protein, 17 aa, Homo sapiens
  Heavy chain CDR3 for antibody 11476 (IGHV3-23)
AKEGSSSSWYGGLYFDY

SEQ ID NO: 22953 - protein, 9 aa, Homo sapiens
  Light chain CDR3 for antibody 11477 (IGKV3-15)
QQYHNWPYT

SEQ ID NO: 22954 - protein, 14 aa, Homo sapiens
  Heavy chain CDR3 for antibody 11477 (IGHV3-20)
ARDEGSGGYDVFDI

SEQ ID NO: 22955 - protein, 9 aa, Homo sapiens
  Light chain CDR3 for antibody 11478 (IGKV2D-28)
MQVLQTPFT

SEQ ID NO: 22956 - protein, 17 aa, Homo sapiens
  Heavy chain CDR3 for antibody 11478 (IGHV4-59)
ARDRELLWFGEFGGMDV

SEQ ID NO: 22957 - protein, 9 aa, Homo sapiens
  Light chain CDR3 for antibody 11479 (IGKV3-20)
QQYGSSPYT

SEQ ID NO: 22958 - protein, 10 aa, Homo sapiens
  Heavy chain CDR3 for antibody 11479 (IGHV4-31)
ARHGVAGTNY

SEQ ID NO: 22959 - protein, 9 aa, Homo sapiens
  Light chain CDR3 for antibody 11480 (IGKV1D-13)
QRFNNYLYT

SEQ ID NO: 22960 - protein, 12 aa, Homo sapiens
  Heavy chain CDR3 for antibody 11480 (IGHV1-18)
ARVLFYGDYFDY

SEQ ID NO: 22961 - protein, 9 aa, Homo sapiens
  Light chain CDR3 for antibody 11481 (IGKV1D-13)
QQFNNYPYT

SEQ ID NO: 22962 - protein, 14 aa, Homo sapiens
  Heavy chain CDR3 for antibody 11481 (IGHV3-33)
ARDLDIMATSPFAY

SEQ ID NO: 22963 - protein, 9 aa, Homo sapiens
  Light chain CDR3 for antibody 11482 (IGKV6-21)
HQSSTLPLT

SEQ ID NO: 22964 - protein, 11 aa, Homo sapiens
  Heavy chain CDR3 for antibody 11482 (IGHV3-30)
ARDQGFGDLTH

SEQ ID NO: 22965 - protein, 8 aa, Homo sapiens
  Light chain CDR3 for antibody 11483 (IGKV3D-7)
QQDYNLVT

SEQ ID NO: 22966 - protein, 18 aa, Homo sapiens
  Heavy chain CDR3 for antibody 11483 (IGHV4-59)
ARERGNWNDVDYYYGMDV

SEQ ID NO: 22967 - protein, 6 aa, Homo sapiens
  Light chain CDR3 for antibody 11484 (IGKV3-20)
QQYGST

SEQ ID NO: 22968 - protein, 8 aa, Homo sapiens
  Heavy chain CDR3 for antibody 11484 (IGHV3-33)
ARDRGFDY

SEQ ID NO: 22969 - protein, 9 aa, Homo sapiens
  Light chain CDR3 for antibody 11485 (IGKV1-9)
QQLTSFPRT

SEQ ID NO: 22970 - protein, 13 aa, Homo sapiens
  Heavy chain CDR3 for antibody 11485 (IGHV3-33)
ARDYCGGDCYLDY

SEQ ID NO: 22971 - protein, 9 aa, Homo sapiens
  Light chain CDR3 for antibody 11486 (IGKV1-9)
QQLISYPLT

SEQ ID NO: 22972 - protein, 13 aa, Homo sapiens
  Heavy chain CDR3 for antibody 11486 (IGHV4-59)
APFRVMVRGVLDY

SEQ ID NO: 22973 - protein, 8 aa, Homo sapiens
  Light chain CDR3 for antibody 11487 (IGKV3-20)
QQYGSSLT

SEQ ID NO: 22974 - protein, 17 aa, Homo sapiens
  Heavy chain CDR3 for antibody 11487 (IGHV3-23)
AKDGIGELSYYYYGMDV

SEQ ID NO: 22975 - protein, 9 aa, Homo sapiens
  Light chain CDR3 for antibody 11488 (IGKV1-16)
QQYNSYPYT

SEQ ID NO: 22976 - protein, 17 aa, Homo sapiens
  Heavy chain CDR3 for antibody 11488 (IGHV1-46)
AKDYDILTGYSHNWFDH

SEQ ID NO: 22977 - protein, 9 aa, Homo sapiens
  Light chain CDR3 for antibody 11489 (IGKV3-11)
QQRSNWPYT

SEQ ID NO: 22978 - protein, 20 aa, Homo sapiens
  Heavy chain CDR3 for antibody 11489 (IGHV3-23)
AKGMGGLRYFDWPHYYGMDV

SEQ ID NO: 22979 - protein, 9 aa, Homo sapiens
  Light chain CDR3 for antibody 11490 (IGKV2-30)
MQGTHWPLT

SEQ ID NO: 22980 - protein, 9 aa, Homo sapiens
  Heavy chain CDR3 for antibody 11490 (IGHV3-30)
ARGRVSLDV

SEQ ID NO: 22981 - protein, 9 aa, Homo sapiens
  Light chain CDR3 for antibody 11491 (IGKV1D-16)
LQDYNYPRT

SEQ ID NO: 22982 - protein, 9 aa, Homo sapiens
  Heavy chain CDR3 for antibody 11491 (IGHV4-59)
ARDDGDFDY

SEQ ID NO: 22983 - protein, 9 aa, Homo sapiens
  Light chain CDR3 for antibody 11492 (IGKV1D-16)
QQYDSYPWT

SEQ ID NO: 22984 - protein, 15 aa, Homo sapiens
  Heavy chain CDR3 for antibody 11492 (IGHV3-33)
AREGLRYFHYYGMDV

SEQ ID NO: 22985 - protein, 9 aa, Homo sapiens
  Light chain CDR3 for antibody 11493 (IGKV1D-13)
QQFNNYPHT

SEQ ID NO: 22986 - protein, 12 aa, Homo sapiens
  Heavy chain CDR3 for antibody 11493 (IGHV3-33)
ARGGFDWGSIDY

SEQ ID NO: 22987 - protein, 9 aa, Homo sapiens
  Light chain CDR3 for antibody 11494 (IGKV1-6)
LQQHSYPWT

SEQ ID NO: 22988 - protein, 14 aa, Homo sapiens
  Heavy chain CDR3 for antibody 11494 (IGHV1-46)
ARKGIVGGFDAFDV

SEQ ID NO: 22989 - protein, 8 aa, Homo sapiens
  Light chain CDR3 for antibody 11495 (IGKV1-13)
QQYNSYWT

SEQ ID NO: 22990 - protein, 14 aa, Homo sapiens
  Heavy chain CDR3 for antibody 11495 (IGHV3-33)
AREEDYYYYYDMDV

SEQ ID NO: 22991 - protein, 9 aa, Homo sapiens
  Light chain CDR3 for antibody 11496 (IGKV1-9)
QQGNTYSRT

SEQ ID NO: 22992 - protein, 11 aa, Homo sapiens
  Heavy chain CDR3 for antibody 11496 (IGHV4-59)
ARDRGLGSFDY

SEQ ID NO: 22993 - protein, 6 aa, Homo sapiens
  Light chain CDR3 for antibody 11497 (IGKV3-20)
QQYGST

SEQ ID NO: 22994 - protein, 14 aa, Homo sapiens
  Heavy chain CDR3 for antibody 11497 (IGHV3-33)
ARDKTYPLSYGMDV

SEQ ID NO: 22995 - protein, 9 aa, Homo sapiens
  Light chain CDR3 for antibody 11498 (IGKV3-11)
QQRSNWPYT

SEQ ID NO: 22996 - protein, 13 aa, Homo sapiens
  Heavy chain CDR3 for antibody 11498 (IGHV3-33)
ARTDYYYYYGLDA

SEQ ID NO: 22997 - protein, 10 aa, Homo sapiens
  Light chain CDR3 for antibody 11499 (IGKV3-11)
QQRSNWPPFT

SEQ ID NO: 22998 - protein, 15 aa, Homo sapiens
  Heavy chain CDR3 for antibody 11499 (IGHV1-46)
ARGRFFDWLLSPFDY

SEQ ID NO: 22999 - protein, 9 aa, Homo sapiens
  Light chain CDR3 for antibody 11500 (IGKV1-6)
LQDYNSPYT

SEQ ID NO: 23000 - protein, 17 aa, Homo sapiens
  Heavy chain CDR3 for antibody 11500 (IGHV3-66)
ARVQYDILTGYSPYFDN

SEQ ID NO: 23001 - protein, 9 aa, Homo sapiens
  Light chain CDR3 for antibody 11501 (IGKV3-20)
QQYNYWPLT

SEQ ID NO: 23002 - protein, 17 aa, Homo sapiens
  Heavy chain CDR3 for antibody 11501 (IGHV3-23)
AKGNYGSGSYYNGDFQH

SEQ ID NO: 23003 - protein, 9 aa, Homo sapiens
  Light chain CDR3 for antibody 11502 (IGKV3-11)
QQRSSWPPT

SEQ ID NO: 23004 - protein, 13 aa, Homo sapiens
  Heavy chain CDR3 for antibody 11502 (IGHV3-33)
VSTGDSYYYVMDV

SEQ ID NO: 23005 - protein, 10 aa, Homo sapiens
  Light chain CDR3 for antibody 11503 (IGKV3-11)
QQRSNWPALT

SEQ ID NO: 23006 - protein, 14 aa, Homo sapiens
  Heavy chain CDR3 for antibody 11503 (IGHV3-33)
ARDLDIMATSPFAY

SEQ ID NO: 23007 - protein, 10 aa, Homo sapiens
  Light chain CDR3 for antibody 11504 (IGKV3-11)
QQRSNWPMYT

SEQ ID NO: 23008 - protein, 12 aa, Homo sapiens
  Heavy chain CDR3 for antibody 11504 (IGHV3-23)
ARDSGSYYYFDY

SEQ ID NO: 23009 - protein, 9 aa, Homo sapiens
  Light chain CDR3 for antibody 11505 (IGKV1-39)
QQGFSTPWT

SEQ ID NO: 23010 - protein, 13 aa, Homo sapiens
  Heavy chain CDR3 for antibody 11505 (IGHV4-39)
ARREVVGGRGFDY

SEQ ID NO: 23011 - protein, 9 aa, Homo sapiens
  Light chain CDR3 for antibody 11506 (IGKV3D-20)
QQYGSSPLT

SEQ ID NO: 23012 - protein, 5 aa, Homo sapiens
  Heavy chain CDR3 for antibody 11506 (IGHV4-39)
ARGDY

SEQ ID NO: 23013 - protein, 9 aa, Homo sapiens
  Light chain CDR3 for antibody 11507 (IGKV1-5)
QQYNTYSRT

SEQ ID NO: 23014 - protein, 23 aa, Homo sapiens
  Heavy chain CDR3 for antibody 11507 (IGHV1-18)
ARNLHYDILTGYFPYYFYYGMDV

SEQ ID NO: 23015 - protein, 9 aa, Homo sapiens
  Light chain CDR3 for antibody 11508 (IGKV1-6)
LQDFHYPWT

SEQ ID NO: 23016 - protein, 13 aa, Homo sapiens
  Heavy chain CDR3 for antibody 11508 (IGHV3-33)
ARKAYGDYFYFDY

SEQ ID NO: 23017 - protein, 8 aa, Homo sapiens
  Light chain CDR3 for antibody 11509 (IGKV1D-13)
QQFNNYPT

SEQ ID NO: 23018 - protein, 14 aa, Homo sapiens
  Heavy chain CDR3 for antibody 11509 (IGHV4-59)
AKGGSGSYYNWFDP

SEQ ID NO: 23019 - protein, 9 aa, Homo sapiens
  Light chain CDR3 for antibody 11510 (IGKV1D-16)
QQYKSYPLT

SEQ ID NO: 23020 - protein, 16 aa, Homo sapiens
  Heavy chain CDR3 for antibody 11510 (IGHV4-59)
ARGRYFEWLSHDAFDI

SEQ ID NO: 23021 - protein, 9 aa, Homo sapiens
  Light chain CDR3 for antibody 11511 (IGKV1-17)
LQHNSFPYT

SEQ ID NO: 23022 - protein, 17 aa, Homo sapiens
  Heavy chain CDR3 for antibody 11511 (IGHV4-39)
ARVLRYFEWLLGDVFDI

SEQ ID NO: 23023 - protein, 8 aa, Homo sapiens
  Light chain CDR3 for antibody 11512 (IGKV3-20)
QQYGSSRT

SEQ ID NO: 23024 - protein, 8 aa, Homo sapiens
  Heavy chain CDR3 for antibody 11512 (IGHV3-23)
AETFLFDY

SEQ ID NO: 23025 - protein, 9 aa, Homo sapiens
  Light chain CDR3 for antibody 11513 (IGKV1D-16)
QQYNYFPLT

SEQ ID NO: 23026 - protein, 13 aa, Homo sapiens
  Heavy chain CDR3 for antibody 11513 (IGHV3-23)
ASPFNWNDDFFDY

SEQ ID NO: 23027 - protein, 9 aa, Homo sapiens
  Light chain CDR3 for antibody 11514 (IGKV1-5)
QQYNSYSWT

SEQ ID NO: 23028 - protein, 13 aa, Homo sapiens
  Heavy chain CDR3 for antibody 11514 (IGHV4-39)
ARHPPSRDYGMDV

SEQ ID NO: 23029 - protein, 9 aa, Homo sapiens
  Light chain CDR3 for antibody 11515 (IGKV3D-20)
QQYGRSPRT

SEQ ID NO: 23030 - protein, 18 aa, Homo sapiens
  Heavy chain CDR3 for antibody 11515 (IGHV3-33)
ARDGYSGYDYYYYYGMDV

SEQ ID NO: 23031 - protein, 9 aa, Homo sapiens
  Light chain CDR3 for antibody 11516 (IGKV1-17)
LQHNSYPYT

SEQ ID NO: 23032 - protein, 19 aa, Homo sapiens
  Heavy chain CDR3 for antibody 11516 (IGHV3-33)
ARDNDSSGYYDYYYYGMDV

SEQ ID NO: 23033 - protein, 8 aa, Homo sapiens
  Light chain CDR3 for antibody 11517 (IGKV3D-7)
QQDYSLLT

SEQ ID NO: 23034 - protein, 16 aa, Homo sapiens
  Heavy chain CDR3 for antibody 11517 (IGHV4-61)
ARGRYFDWLLGDVFDI

SEQ ID NO: 23035 - protein, 8 aa, Homo sapiens
  Light chain CDR3 for antibody 11518 (IGKV3D-7)
QQDYNSLT

SEQ ID NO: 23036 - protein, 26 aa, Homo sapiens
  Heavy chain CDR3 for antibody 11518 (IGHV4-39)
ARQGLLWFGDLKAYDSSGYYYGYFHH

SEQ ID NO: 23037 - protein, 10 aa, Homo sapiens
  Light chain CDR3 for antibody 11519 (IGKV1-39)
QQSYSSPMYT

SEQ ID NO: 23038 - protein, 18 aa, Homo sapiens
  Heavy chain CDR3 for antibody 11519 (IGHV3-33)
ARGGVLYDILTGFYGMDV

SEQ ID NO: 23039 - protein, 10 aa, Homo sapiens
  Light chain CDR3 for antibody 11520 (IGKV1-9)
QQLDSYPMYT

SEQ ID NO: 23040 - protein, 17 aa, Homo sapiens
  Heavy chain CDR3 for antibody 11520 (IGHV4-39)
ARVLRYFDWLSHDAFDI

SEQ ID NO: 23041 - protein, 8 aa, Homo sapiens
  Light chain CDR3 for antibody 11521 (IGKV1D-13)
QQFNNYPT

SEQ ID NO: 23042 - protein, 14 aa, Homo sapiens
  Heavy chain CDR3 for antibody 11521 (IGHV3-33)
ARTTAAAGPRDFQH

SEQ ID NO: 23043 - protein, 9 aa, Homo sapiens
  Light chain CDR3 for antibody 11522 (IGKV1D-13)
QQFNNYPHT

SEQ ID NO: 23044 - protein, 12 aa, Homo sapiens
  Heavy chain CDR3 for antibody 11522 (IGHV3-33)
AREEAVAEAFDI

SEQ ID NO: 23045 - protein, 9 aa, Homo sapiens
  Light chain CDR3 for antibody 11523 (IGKV1-9)
QQLISYPLT

SEQ ID NO: 23046 - protein, 14 aa, Homo sapiens
  Heavy chain CDR3 for antibody 11523 (IGHV3-33)
ARDRDIMATSYFDY

SEQ ID NO: 23047 - protein, 10 aa, Homo sapiens
  Light chain CDR3 for antibody 11524 (IGKV3-11)
QQRSNWPIFT

SEQ ID NO: 23048 - protein, 12 aa, Homo sapiens
  Heavy chain CDR3 for antibody 11524 (IGHV3-23)
ARGYFGSGYAHF

SEQ ID NO: 23049 - protein, 9 aa, Homo sapiens
  Light chain CDR3 for antibody 11525 (IGKV2D-28)
MQVLQTPFT

SEQ ID NO: 23050 - protein, 12 aa, Homo sapiens
  Heavy chain CDR3 for antibody 11525 (IGHV4-39)
ASQMVREGWFDP

SEQ ID NO: 23051 - protein, 8 aa, Homo sapiens
  Light chain CDR3 for antibody 11526 (IGKV1-5)
QQYNSYYT

SEQ ID NO: 23052 - protein, 12 aa, Homo sapiens
  Heavy chain CDR3 for antibody 11526 (IGHV3-33)
ARKQWLVQAFDI

SEQ ID NO: 23053 - protein, 9 aa, Homo sapiens
  Light chain CDR3 for antibody 11527 (IGKV6-21)
HQSSSLPHT

SEQ ID NO: 23054 - protein, 11 aa, Homo sapiens
  Heavy chain CDR3 for antibody 11527 (IGHV4-59)
ARDRGHYGMDV

SEQ ID NO: 23055 - protein, 9 aa, Homo sapiens
  Light chain CDR3 for antibody 11528 (IGKV1-9)
QQLISYPLT

SEQ ID NO: 23056 - protein, 8 aa, Homo sapiens
  Heavy chain CDR3 for antibody 11528 (IGHV3-33)
ARDRGFDY

SEQ ID NO: 23057 - protein, 10 aa, Homo sapiens
  Light chain CDR3 for antibody 11529 (IGKV1-17)
LQHNSYPMYT

SEQ ID NO: 23058 - protein, 13 aa, Homo sapiens
  Heavy chain CDR3 for antibody 11529 (IGHV3-33)
AKEDGDYHHYFDY

SEQ ID NO: 23059 - protein, 10 aa, Homo sapiens
  Light chain CDR3 for antibody 11530 (IGKV3-20)
QQYGRSPPVT

SEQ ID NO: 23060 - protein, 16 aa, Homo sapiens
  Heavy chain CDR3 for antibody 11530 (IGHV4-59)
ARDTPYYSGSGRPFDH

SEQ ID NO: 23061 - protein, 9 aa, Homo sapiens
  Light chain CDR3 for antibody 11531 (IGKV6-21)
QQSSNLPHT

SEQ ID NO: 23062 - protein, 14 aa, Homo sapiens
  Heavy chain CDR3 for antibody 11531 (IGHV3-33)
ARDNILTAYYLFDY

SEQ ID NO: 23063 - protein, 9 aa, Homo sapiens
  Light chain CDR3 for antibody 11532 (IGKV1-27)
QKYNSAPYT

SEQ ID NO: 23064 - protein, 11 aa, Homo sapiens
  Heavy chain CDR3 for antibody 11532 (IGHV3-64)
ARERGSYAFDI

SEQ ID NO: 23065 - protein, 9 aa, Homo sapiens
  Light chain CDR3 for antibody 11533 (IGKV3D-7)
QQDYEFPIT

SEQ ID NO: 23066 - protein, 17 aa, Homo sapiens
  Heavy chain CDR3 for antibody 11533 (IGHV4-34)
AGLRCFDWLFDYYGMDV

SEQ ID NO: 23067 - protein, 8 aa, Homo sapiens
  Light chain CDR3 for antibody 11534 (IGKV3D-7)
QQDYSLLT

SEQ ID NO: 23068 - protein, 15 aa, Homo sapiens
  Heavy chain CDR3 for antibody 11534 (IGHV3-33)
ARGYYYGAGSFPFDY

SEQ ID NO: 23069 - protein, 9 aa, Homo sapiens
  Light chain CDR3 for antibody 11535 (IGKV2D-28)
MQALQTPPT

SEQ ID NO: 23070 - protein, 10 aa, Homo sapiens
  Heavy chain CDR3 for antibody 11535 (IGHV3-23)
AREWYGGMDV

SEQ ID NO: 23071 - protein, 8 aa, Homo sapiens
  Light chain CDR3 for antibody 11536 (IGKV1-5)
QQYNSYWT

SEQ ID NO: 23072 - protein, 20 aa, Homo sapiens
  Heavy chain CDR3 for antibody 11536 (IGHV3-33)
ARRMVRGVKKAYYYYYGLDV

SEQ ID NO: 23073 - protein, 9 aa, Homo sapiens
  Light chain CDR3 for antibody 11537 (IGKV1-39)
QQSYSTPLT

SEQ ID NO: 23074 - protein, 16 aa, Homo sapiens
  Heavy chain CDR3 for antibody 11537 (IGHV3-23)
ARNDILTASGYYGMDV

SEQ ID NO: 23075 - protein, 8 aa, Homo sapiens
  Light chain CDR3 for antibody 11538 (IGKV1D-13)
QQFNNYPT

SEQ ID NO: 23076 - protein, 18 aa, Homo sapiens
  Heavy chain CDR3 for antibody 11538 (IGHV3-30)
ARDRYYDILTGYSDAFEI

SEQ ID NO: 23077 - protein, 9 aa, Homo sapiens
  Light chain CDR3 for antibody 11539 (IGKV3D-7)
QQDYTLPLT

SEQ ID NO: 23078 - protein, 11 aa, Homo sapiens
  Heavy chain CDR3 for antibody 11539 (IGHV4-59)
ARVYSSSWYDY

SEQ ID NO: 23079 - protein, 9 aa, Homo sapiens
  Light chain CDR3 for antibody 11540 (IGKV1-12)
QQSYSTPFT

SEQ ID NO: 23080 - protein, 12 aa, Homo sapiens
  Heavy chain CDR3 for antibody 11540 (IGHV3-33)
ARDRAYRGSRDY

SEQ ID NO: 23081 - protein, 9 aa, Homo sapiens
  Light chain CDR3 for antibody 11541 (IGKV4-1)
QQYYTTPPT

SEQ ID NO: 23082 - protein, 13 aa, Homo sapiens
  Heavy chain CDR3 for antibody 11541 (IGHV3-33)
ARRYRSGWYPFDY

SEQ ID NO: 23083 - protein, 8 aa, Homo sapiens
  Light chain CDR3 for antibody 11542 (IGKV3-11)
QQRGNWPS

SEQ ID NO: 23084 - protein, 9 aa, Homo sapiens
  Heavy chain CDR3 for antibody 11542 (IGHV3-33)
ARELAYFDY

SEQ ID NO: 23085 - protein, 9 aa, Homo sapiens
  Light chain CDR3 for antibody 11543 (IGKV3D-7)
QQDYNLPWT

SEQ ID NO: 23086 - protein, 17 aa, Homo sapiens
  Heavy chain CDR3 for antibody 11543 (IGHV3-23)
AKDRDWKDGYYYFGMDV

SEQ ID NO: 23087 - protein, 8 aa, Homo sapiens
  Light chain CDR3 for antibody 11544 (IGKV3D-7)
QQDYNSLT

SEQ ID NO: 23088 - protein, 18 aa, Homo sapiens
  Heavy chain CDR3 for antibody 11544 (IGHV3-33)
ARRGVGARGYYYYYGMDV

SEQ ID NO: 23089 - protein, 9 aa, Homo sapiens
  Light chain CDR3 for antibody 11545 (IGKV3D-7)
QQDYDLPYP

SEQ ID NO: 23090 - protein, 11 aa, Homo sapiens
  Heavy chain CDR3 for antibody 11545 (IGHV4-59)
AREMGHDTFDI

SEQ ID NO: 23091 - protein, 8 aa, Homo sapiens
  Light chain CDR3 for antibody 11546 (IGKV3-20)
QQYGSSLT

SEQ ID NO: 23092 - protein, 11 aa, Homo sapiens
  Heavy chain CDR3 for antibody 11546 (IGHV3-33)
ARARYTTGLDY

SEQ ID NO: 23093 - protein, 10 aa, Homo sapiens
  Light chain CDR3 for antibody 11547 (IGKV3-15)
QQYNNWPPIT

SEQ ID NO: 23094 - protein, 13 aa, Homo sapiens
  Heavy chain CDR3 for antibody 11547 (IGHV3-33)
AKEDGDYHHYFDY

SEQ ID NO: 23095 - protein, 9 aa, Homo sapiens
  Light chain CDR3 for antibody 11548 (IGKV1-17)
QQYYSYPYT

SEQ ID NO: 23096 - protein, 9 aa, Homo sapiens
  Heavy chain CDR3 for antibody 11548 (IGHV3-30)
ARDSWGFDY

SEQ ID NO: 23097 - protein, 9 aa, Homo sapiens
  Light chain CDR3 for antibody 11549 (IGKV1-13)
QKYNSAPYT

SEQ ID NO: 23098 - protein, 12 aa, Homo sapiens
  Heavy chain CDR3 for antibody 11549 (IGHV3-66)
STGYFGSSYAHF

SEQ ID NO: 23099 - protein, 9 aa, Homo sapiens
  Light chain CDR3 for antibody 11550 (IGKV1-39)
QQGFSTPWT

SEQ ID NO: 23100 - protein, 18 aa, Homo sapiens
  Heavy chain CDR3 for antibody 11550 (IGHV3-33)
ARGGYSSGWDYYYYGMDV

SEQ ID NO: 23101 - protein, 8 aa, Homo sapiens
  Light chain CDR3 for antibody 11551 (IGKV1-5)
QQYNSYYT

SEQ ID NO: 23102 - protein, 11 aa, Homo sapiens
  Heavy chain CDR3 for antibody 11551 (IGHV3-33)
ARGTTVTHFDY

SEQ ID NO: 23103 - protein, 9 aa, Homo sapiens
  Light chain CDR3 for antibody 11552 (IGKV1-6)
LQDYNHPFT

SEQ ID NO: 23104 - protein, 14 aa, Homo sapiens
  Heavy chain CDR3 for antibody 11552 (IGHV3-33)
ARDRRDFYYYCRDV

SEQ ID NO: 23105 - protein, 9 aa, Homo sapiens
  Light chain CDR3 for antibody 11553 (IGKV5-2)
LQHDNFPYT

SEQ ID NO: 23106 - protein, 16 aa, Homo sapiens
  Heavy chain CDR3 for antibody 11553 (IGHV4-59)
ARQLLWFGELKGVFDY

SEQ ID NO: 23107 - protein, 9 aa, Homo sapiens
  Light chain CDR3 for antibody 11554 (IGKV2D-28)
MQALQTPPT

SEQ ID NO: 23108 - protein, 20 aa, Homo sapiens
  Heavy chain CDR3 for antibody 11554 (IGHV3-11)
ARGGATLIRGLIDYYYGMDV

SEQ ID NO: 23109 - protein, 9 aa, Homo sapiens
  Light chain CDR3 for antibody 11555 (IGKV1-6)
LQDYTYPYT

SEQ ID NO: 23110 - protein, 16 aa, Homo sapiens
  Heavy chain CDR3 for antibody 11555 (IGHV4-59)
ARDTPYYSGSGRPFDH

SEQ ID NO: 23111 - protein, 9 aa, Homo sapiens
  Light chain CDR3 for antibody 11556 (IGKV1-16)
QHYNDYPFT

SEQ ID NO: 23112 - protein, 17 aa, Homo sapiens
  Heavy chain CDR3 for antibody 11556 (IGHV3-33)
ARESLKLGIYYYYGMDV

SEQ ID NO: 23113 - protein, 9 aa, Homo sapiens
  Light chain CDR3 for antibody 11557 (IGKV1-16)
QHYNDYPFT

SEQ ID NO: 23114 - protein, 12 aa, Homo sapiens
  Heavy chain CDR3 for antibody 11557 (IGHV3-33)
AREEAVAEAFDI

SEQ ID NO: 23115 - protein, 8 aa, Homo sapiens
  Light chain CDR3 for antibody 11558 (IGKV1-5)
QQYNSYYT

SEQ ID NO: 23116 - protein, 12 aa, Homo sapiens
  Heavy chain CDR3 for antibody 11558 (IGHV3-23)
ARVNSGSPYFDY

SEQ ID NO: 23117 - protein, 8 aa, Homo sapiens
  Light chain CDR3 for antibody 11559 (IGKV3-11)
QQRGNWPS

SEQ ID NO: 23118 - protein, 15 aa, Homo sapiens
  Heavy chain CDR3 for antibody 11559 (IGHV3-33)
ARDRGWKAPGYGMDV

SEQ ID NO: 23119 - protein, 9 aa, Homo sapiens
  Light chain CDR3 for antibody 11560 (IGKV1-6)
LQDYKSPFT

SEQ ID NO: 23120 - protein, 15 aa, Homo sapiens
  Heavy chain CDR3 for antibody 11560 (IGHV3-23)
AKEFTMVRGVITPDY

SEQ ID NO: 23121 - protein, 10 aa, Homo sapiens
  Light chain CDR3 for antibody 11561 (IGKV1-17)
QQLDSYPMYT

SEQ ID NO: 23122 - protein, 14 aa, Homo sapiens
  Heavy chain CDR3 for antibody 11561 (IGHV3-20)
ARDGGSTCYDWFDP

SEQ ID NO: 23123 - protein, 9 aa, Homo sapiens
  Light chain CDR3 for antibody 11562 (IGKV1-9)
QQLHIYPWT

SEQ ID NO: 23124 - protein, 13 aa, Homo sapiens
  Heavy chain CDR3 for antibody 11562 (IGHV3-33)
ARDYTMVRGVMNY

SEQ ID NO: 23125 - protein, 10 aa, Homo sapiens
  Light chain CDR3 for antibody 11563 (IGKV3-11)
QQRSNWLMYT

SEQ ID NO: 23126 - protein, 13 aa, Homo sapiens
  Heavy chain CDR3 for antibody 11563 (IGHV3-53)
ARSGSYWGYYFDY

SEQ ID NO: 23127 - protein, 9 aa, Homo sapiens
  Light chain CDR3 for antibody 11564 (IGKV1-16)
QHYNDYPFT

SEQ ID NO: 23128 - protein, 10 aa, Homo sapiens
  Heavy chain CDR3 for antibody 11564 (IGHV3-33)
ARNILTPLDY

SEQ ID NO: 23129 - protein, 10 aa, Homo sapiens
  Light chain CDR3 for antibody 11565 (IGKV3-20)
QQYGRSPPVT

SEQ ID NO: 23130 - protein, 10 aa, Homo sapiens
  Heavy chain CDR3 for antibody 11565 (IGHV3-23)
ATIVGPFLDV

SEQ ID NO: 23131 - protein, 9 aa, Homo sapiens
  Light chain CDR3 for antibody 11566 (IGKV1-17)
LQHTSYPFT

SEQ ID NO: 23132 - protein, 17 aa, Homo sapiens
  Heavy chain CDR3 for antibody 11566 (IGHV3-33)
ARGEQWLGYYYYYGMDV

SEQ ID NO: 23133 - protein, 10 aa, Homo sapiens
  Light chain CDR3 for antibody 11567 (IGKV3-11)
QQRSNWLMYT

SEQ ID NO: 23134 - protein, 9 aa, Homo sapiens
  Heavy chain CDR3 for antibody 11567 (IGHV4-59)
AREGGSGSL

SEQ ID NO: 23135 - protein, 8 aa, Homo sapiens
  Light chain CDR3 for antibody 11568 (IGKV3-15)
QQYNNYPT

SEQ ID NO: 23136 - protein, 26 aa, Homo sapiens
  Heavy chain CDR3 for antibody 11568 (IGHV4-39)
ARQGLLWFGDLKAYDSSGYYYGYFHH

SEQ ID NO: 23137 - protein, 10 aa, Homo sapiens
  Light chain CDR3 for antibody 11569 (IGKV3-11)
QQRSNWLMYT

SEQ ID NO: 23138 - protein, 13 aa, Homo sapiens
  Heavy chain CDR3 for antibody 11569 (IGHV4-39)
ARREVVGGRGFDY

SEQ ID NO: 23139 - protein, 9 aa, Homo sapiens
  Light chain CDR3 for antibody 11570 (IGKV3-15)
QQYHNWPLT

SEQ ID NO: 23140 - protein, 10 aa, Homo sapiens
  Heavy chain CDR3 for antibody 11570 (IGHV3-23)
AKENWNDFDY

SEQ ID NO: 23141 - protein, 9 aa, Homo sapiens
  Light chain CDR3 for antibody 11571 (IGKV2D-28)
MQALQTPPT

SEQ ID NO: 23142 - protein, 15 aa, Homo sapiens
  Heavy chain CDR3 for antibody 11571 (IGHV3-64)
ARDSRPEITGPPFDY

SEQ ID NO: 23143 - protein, 8 aa, Homo sapiens
  Light chain CDR3 for antibody 11572 (IGKV6-21)
HQSSSLPT

SEQ ID NO: 23144 - protein, 17 aa, Homo sapiens
  Heavy chain CDR3 for antibody 11572 (IGHV3-33)
ARESLKLGIYYYYGMDV

SEQ ID NO: 23145 - protein, 9 aa, Homo sapiens
  Light chain CDR3 for antibody 11573 (IGKV1-17)
LQHNSYPPT

SEQ ID NO: 23146 - protein, 17 aa, Homo sapiens
  Heavy chain CDR3 for antibody 11573 (IGHV4-39)
ARERILWFGEFTYYFDY

SEQ ID NO: 23147 - protein, 9 aa, Homo sapiens
  Light chain CDR3 for antibody 11574 (IGKV1-27)
QQLNTYPWT

SEQ ID NO: 23148 - protein, 21 aa, Homo sapiens
  Heavy chain CDR3 for antibody 11574 (IGHV4-59)
AAGVLLWFGEPNYYYYYGMDV

SEQ ID NO: 23149 - protein, 9 aa, Homo sapiens
  Light chain CDR3 for antibody 11575 (IGKV1-5)
QQYNTYSRT

SEQ ID NO: 23150 - protein, 19 aa, Homo sapiens
  Heavy chain CDR3 for antibody 11575 (IGHV3-33)
ARGVRLRYFDPYYYYGMDV

SEQ ID NO: 23151 - protein, 8 aa, Homo sapiens
  Light chain CDR3 for antibody 11576 (IGKV1-17)
QQYNSYYT

SEQ ID NO: 23152 - protein, 18 aa, Homo sapiens
  Heavy chain CDR3 for antibody 11576 (IGHV4-59)
ARERGNWNDVDYYYGMDV

SEQ ID NO: 23153 - protein, 9 aa, Homo sapiens
  Light chain CDR3 for antibody 11577 (IGKV5-2)
LQHDKFPYT

SEQ ID NO: 23154 - protein, 16 aa, Homo sapiens
  Heavy chain CDR3 for antibody 11577 (IGHV4-59)
ARDTPYYSGSGRPFDH

SEQ ID NO: 23155 - protein, 10 aa, Homo sapiens
  Light chain CDR3 for antibody 11578 (IGKV1-17)
LQHNSYPMYT

SEQ ID NO: 23156 - protein, 12 aa, Homo sapiens
  Heavy chain CDR3 for antibody 11578 (IGHV4-61)
ARVYSSGWLFDY

SEQ ID NO: 23157 - protein, 8 aa, Homo sapiens
  Light chain CDR3 for antibody 11579 (IGKV3-20)
QQYGRSFT

SEQ ID NO: 23158 - protein, 17 aa, Homo sapiens
  Heavy chain CDR3 for antibody 11579 (IGHV1-18)
ARERYYGSGNYKYNMDV

SEQ ID NO: 23159 - protein, 9 aa, Homo sapiens
  Light chain CDR3 for antibody 11580 (IGKV1D-16)
QQYNSYPYT

SEQ ID NO: 23160 - protein, 14 aa, Homo sapiens
  Heavy chain CDR3 for antibody 11580 (IGHV3-33)
AREDYYGPLDWFDH

SEQ ID NO: 23161 - protein, 9 aa, Homo sapiens
  Light chain CDR3 for antibody 11581 (IGKV3-15)
QQYNNWPRT

SEQ ID NO: 23162 - protein, 11 aa, Homo sapiens
  Heavy chain CDR3 for antibody 11581 (IGHV3-33)
ARAGIAALFDY

SEQ ID NO: 23163 - protein, 8 aa, Homo sapiens
  Light chain CDR3 for antibody 11582 (IGKV3-20)
QQYGSSLT

SEQ ID NO: 23164 - protein, 17 aa, Homo sapiens
  Heavy chain CDR3 for antibody 11582 (IGHV4-39)
ARQGWYYGSGSSLLFDY

SEQ ID NO: 23165 - protein, 11 aa, Homo sapiens
  Light chain CDR3 for antibody 11583 (IGKV3-11)
QQRSNWPPTWT

SEQ ID NO: 23166 - protein, 14 aa, Homo sapiens
  Heavy chain CDR3 for antibody 11583 (IGHV3-15)
SIYYYGSGRDFFDY

SEQ ID NO: 23167 - protein, 9 aa, Homo sapiens
  Light chain CDR3 for antibody 11584 (IGKV1-6)
LQDYNYPRT

SEQ ID NO: 23168 - protein, 19 aa, Homo sapiens
  Heavy chain CDR3 for antibody 11584 (IGHV1-18)
AREVGIAVAGTLYYYGMDV

SEQ ID NO: 23169 - protein, 9 aa, Homo sapiens
  Light chain CDR3 for antibody 11585 (IGKV1-27)
QKYNSAPYT

SEQ ID NO: 23170 - protein, 11 aa, Homo sapiens
  Heavy chain CDR3 for antibody 11585 (IGHV3-33)
ARDQGGSSFDY

SEQ ID NO: 23171 - protein, 9 aa, Homo sapiens
  Light chain CDR3 for antibody 11586 (IGKV1-6)
LQDFHYPWT

SEQ ID NO: 23172 - protein, 20 aa, Homo sapiens
  Heavy chain CDR3 for antibody 11586 (IGHV3-23)
AKDREMAATSHYYYYYGMDV

SEQ ID NO: 23173 - protein, 9 aa, Homo sapiens
  Light chain CDR3 for antibody 11587 (IGKV1-5)
QQYNTYSRT

SEQ ID NO: 23174 - protein, 14 aa, Homo sapiens
  Heavy chain CDR3 for antibody 11587 (IGHV1-2)
ARDYYGSGNYYMGY

SEQ ID NO: 23175 - protein, 9 aa, Homo sapiens
  Light chain CDR3 for antibody 11588 (IGKV4-1)
QQYYTYPYT

SEQ ID NO: 23176 - protein, 13 aa, Homo sapiens
  Heavy chain CDR3 for antibody 11588 (IGHV3-33)
ARGDNWNDGGFDY

SEQ ID NO: 23177 - protein, 8 aa, Homo sapiens
  Light chain CDR3 for antibody 11589 (IGKV3-20)
QQYGSSLT

SEQ ID NO: 23178 - protein, 18 aa, Homo sapiens
  Heavy chain CDR3 for antibody 11589 (IGHV3-30)
ARDRHHDILTGYSDAFEI

SEQ ID NO: 23179 - protein, 9 aa, Homo sapiens
  Light chain CDR3 for antibody 11590 (IGKV1-27)
QKYNSAPYT

SEQ ID NO: 23180 - protein, 15 aa, Homo sapiens
  Heavy chain CDR3 for antibody 11590 (IGHV4-39)
ARRDYDISTGYLFDY

SEQ ID NO: 23181 - protein, 9 aa, Homo sapiens
  Light chain CDR3 for antibody 11591 (IGKV1-39)
QQYYSTPWT

SEQ ID NO: 23182 - protein, 11 aa, Homo sapiens
  Heavy chain CDR3 for antibody 11591 (IGHV1-24)
ATELGLYYFDY

SEQ ID NO: 23183 - protein, 8 aa, Homo sapiens
  Light chain CDR3 for antibody 11592 (IGKV1-5)
QQYNTYSS

SEQ ID NO: 23184 - protein, 9 aa, Homo sapiens
  Heavy chain CDR3 for antibody 11592 (IGHV4-59)
AREGGSGSL

SEQ ID NO: 23185 - protein, 9 aa, Homo sapiens
  Light chain CDR3 for antibody 11593 (IGKV3-11)
QQYSDWPLT

SEQ ID NO: 23186 - protein, 12 aa, Homo sapiens
  Heavy chain CDR3 for antibody 11593 (IGHV3-33)
ARESGGSYSFDY

SEQ ID NO: 23187 - protein, 11 aa, Homo sapiens
  Light chain CDR3 for antibody 11594 (IGKV3-11)
QQRSNWPPTWT

SEQ ID NO: 23188 - protein, 15 aa, Homo sapiens
  Heavy chain CDR3 for antibody 11594 (IGHV3-33)
ARDHLTGYYYYGMDV

SEQ ID NO: 23189 - protein, 9 aa, Homo sapiens
  Light chain CDR3 for antibody 11595 (IGKV1-9)
QQLKSYPYT

SEQ ID NO: 23190 - protein, 14 aa, Homo sapiens
  Heavy chain CDR3 for antibody 11595 (IGHV1-69)
ARAYYAFLTGALDI

SEQ ID NO: 23191 - protein, 9 aa, Homo sapiens
  Light chain CDR3 for antibody 11596 (IGKV1D-13)
QHFNNYMYT

SEQ ID NO: 23192 - protein, 23 aa, Homo sapiens
  Heavy chain CDR3 for antibody 11596 (IGHV4-59)
ARERTYSDILPGYYEDYYYGMDV

SEQ ID NO: 23193 - protein, 10 aa, Homo sapiens
  Light chain CDR3 for antibody 11597 (IGKV3-11)
QQRSNWPAYT

SEQ ID NO: 23194 - protein, 10 aa, Homo sapiens
  Heavy chain CDR3 for antibody 11597 (IGHV3-33)
ARNILTPLDY

SEQ ID NO: 23195 - protein, 11 aa, Homo sapiens
  Light chain CDR3 for antibody 11598 (IGKV3-11)
QQRSNWPPMYT

SEQ ID NO: 23196 - protein, 10 aa, Homo sapiens
  Heavy chain CDR3 for antibody 11598 (IGHV1-18)
AREQRLGFDY

SEQ ID NO: 23197 - protein, 9 aa, Homo sapiens
  Light chain CDR3 for antibody 11599 (IGKV1D-16)
QQYNSYPYT

SEQ ID NO: 23198 - protein, 15 aa, Homo sapiens
  Heavy chain CDR3 for antibody 11599 (IGHV3-33)
ARDQRYSSGWNWFDP

SEQ ID NO: 23199 - protein, 9 aa, Homo sapiens
  Light chain CDR3 for antibody 11600 (IGKV3-11)
QQRSNWPLT

SEQ ID NO: 23200 - protein, 20 aa, Homo sapiens
  Heavy chain CDR3 for antibody 11600 (IGHV3-33)
ARDLGWATMVRGVIRAPFDY

SEQ ID NO: 23201 - protein, 10 aa, Homo sapiens
  Light chain CDR3 for antibody 11601 (IGKV1-9)
QQLDSYPMYT

SEQ ID NO: 23202 - protein, 13 aa, Homo sapiens
  Heavy chain CDR3 for antibody 11601 (IGHV3-33)
ARTDYYSYYGLDV

SEQ ID NO: 23203 - protein, 10 aa, Homo sapiens
  Light chain CDR3 for antibody 11602 (IGKV3-11)
QQRSNWLMYT

SEQ ID NO: 23204 - protein, 15 aa, Homo sapiens
  Heavy chain CDR3 for antibody 11602 (IGHV3-30)
ARRGYGSGSPDAFDL

SEQ ID NO: 23205 - protein, 10 aa, Homo sapiens
  Light chain CDR3 for antibody 11603 (IGKV1-9)
QQLDSYPMYT

SEQ ID NO: 23206 - protein, 9 aa, Homo sapiens
  Heavy chain CDR3 for antibody 11603 (IGHV3-13)
ARDHWYFDL

SEQ ID NO: 23207 - protein, 9 aa, Homo sapiens
  Light chain CDR3 for antibody 11604 (IGKV1-9)
QQLNGYPFT

SEQ ID NO: 23208 - protein, 13 aa, Homo sapiens
  Heavy chain CDR3 for antibody 11604 (IGHV4-39)
ARHEVMIRGVFDY

SEQ ID NO: 23209 - protein, 9 aa, Homo sapiens
  Light chain CDR3 for antibody 11605 (IGKV1-9)
QQLNSYPYT

SEQ ID NO: 23210 - protein, 12 aa, Homo sapiens
  Heavy chain CDR3 for antibody 11605 (IGHV3-33)
AREGDILTSYSL

SEQ ID NO: 23211 - protein, 8 aa, Homo sapiens
  Light chain CDR3 for antibody 11606 (IGKV1D-13)
QQFNNYPT

SEQ ID NO: 23212 - protein, 15 aa, Homo sapiens
  Heavy chain CDR3 for antibody 11606 (IGHV3-33)
ARDGSGSYSLYGMDV

SEQ ID NO: 23213 - protein, 9 aa, Homo sapiens
  Light chain CDR3 for antibody 11607 (IGKV1-6)
LQDFNYPRT

SEQ ID NO: 23214 - protein, 17 aa, Homo sapiens
  Heavy chain CDR3 for antibody 11607 (IGHV4-59)
ARDFLVRGEGSYYGMDV

SEQ ID NO: 23215 - protein, 9 aa, Homo sapiens
  Light chain CDR3 for antibody 11608 (IGKV1-6)
LQDYSYPWT

SEQ ID NO: 23216 - protein, 18 aa, Homo sapiens
  Heavy chain CDR3 for antibody 11608 (IGHV4-59)
AREGDYVCGSYRPNWFDP

SEQ ID NO: 23217 - protein, 8 aa, Homo sapiens
  Light chain CDR3 for antibody 11609 (IGKV3D-7)
QQDYSLLT

SEQ ID NO: 23218 - protein, 17 aa, Homo sapiens
  Heavy chain CDR3 for antibody 11609 (IGHV3-33)
ARAYYDILTGYSYYFDY

SEQ ID NO: 23219 - protein, 8 aa, Homo sapiens
  Light chain CDR3 for antibody 11610 (IGKV6-21)
HQSSSLPT

SEQ ID NO: 23220 - protein, 12 aa, Homo sapiens
  Heavy chain CDR3 for antibody 11610 (IGHV3-33)
ARKQWLVQAFDI

SEQ ID NO: 23221 - protein, 8 aa, Homo sapiens
  Light chain CDR3 for antibody 11611 (IGKV3-11)
LQRGNWPT

SEQ ID NO: 23222 - protein, 17 aa, Homo sapiens
  Heavy chain CDR3 for antibody 11611 (IGHV3-15)
TTERYPRRYYYYFGMDV

SEQ ID NO: 23223 - protein, 11 aa, Homo sapiens
  Light chain CDR3 for antibody 11612 (IGKV3-11)
QQRSNWPPTWT

SEQ ID NO: 23224 - protein, 21 aa, Homo sapiens
  Heavy chain CDR3 for antibody 11612 (IGHV4-59)
AAGVLLWFGEPNYYYYYGMDV

SEQ ID NO: 23225 - protein, 9 aa, Homo sapiens
  Light chain CDR3 for antibody 11613 (IGKV5-2)
LQHDNFPYT

SEQ ID NO: 23226 - protein, 13 aa, Homo sapiens
  Heavy chain CDR3 for antibody 11613 (IGHV4-59)
ARERYFASYCMDV

SEQ ID NO: 23227 - protein, 10 aa, Homo sapiens
  Light chain CDR3 for antibody 11614 (IGKV3-11)
QQRSNWPIYT

SEQ ID NO: 23228 - protein, 13 aa, Homo sapiens
  Heavy chain CDR3 for antibody 11614 (IGHV3-33)
TRRIAVAGAEGDY

SEQ ID NO: 23229 - protein, 8 aa, Homo sapiens
  Light chain CDR3 for antibody 11615 (IGKV1-5)
QQYNSYYT

SEQ ID NO: 23230 - protein, 21 aa, Homo sapiens
  Heavy chain CDR3 for antibody 11615 (IGHV3-33)
AKDIDYYGSGSYPLYYYGMDV

SEQ ID NO: 23231 - protein, 11 aa, Homo sapiens
  Light chain CDR3 for antibody 11616 (IGKV3-11)
QQRSNWPPTWT

SEQ ID NO: 23232 - protein, 9 aa, Homo sapiens
  Heavy chain CDR3 for antibody 11616 (IGHV4-59)
ARSGSGIYT

SEQ ID NO: 23233 - protein, 10 aa, Homo sapiens
  Light chain CDR3 for antibody 11617 (IGKV3-11)
QQRSNWPALT

SEQ ID NO: 23234 - protein, 12 aa, Homo sapiens
  Heavy chain CDR3 for antibody 11617 (IGHV3-21)
AREGFGESSFDY

SEQ ID NO: 23235 - protein, 10 aa, Homo sapiens
  Light chain CDR3 for antibody 11618 (IGKV3-11)
QQRSNWPIFT

SEQ ID NO: 23236 - protein, 17 aa, Homo sapiens
  Heavy chain CDR3 for antibody 11618 (IGHV4-59)
AREEDYYGSGSFGTFDI

SEQ ID NO: 23237 - protein, 9 aa, Homo sapiens
  Light chain CDR3 for antibody 11619 (IGKV3D-20)
QQYGSSPYT

SEQ ID NO: 23238 - protein, 18 aa, Homo sapiens
  Heavy chain CDR3 for antibody 11619 (IGHV3-33)
ARDRYHDILAGYYMGFDY

SEQ ID NO: 23239 - protein, 9 aa, Homo sapiens
  Light chain CDR3 for antibody 11620 (IGKV1-17)
LQRNSYPYT

SEQ ID NO: 23240 - protein, 14 aa, Homo sapiens
  Heavy chain CDR3 for antibody 11620 (IGHV3-33)
ARDNILTVYYLFDY

SEQ ID NO: 23241 - protein, 10 aa, Homo sapiens
  Light chain CDR3 for antibody 11621 (IGKV3-11)
QQRSNWPIFT

SEQ ID NO: 23242 - protein, 18 aa, Homo sapiens
  Heavy chain CDR3 for antibody 11621 (IGHV3-33)
ARDHYDILTGYYKGWFDP

SEQ ID NO: 23243 - protein, 9 aa, Homo sapiens
  Light chain CDR3 for antibody 11622 (IGKV1-27)
QKYNSAPYT

SEQ ID NO: 23244 - protein, 13 aa, Homo sapiens
  Heavy chain CDR3 for antibody 11622 (IGHV3-15)
TTDRLLLFGAFDY

SEQ ID NO: 23245 - protein, 9 aa, Homo sapiens
  Light chain CDR3 for antibody 11623 (IGKV2-30)
MQGTHWPLT

SEQ ID NO: 23246 - protein, 14 aa, Homo sapiens
  Heavy chain CDR3 for antibody 11623 (IGHV3-33)
ARGLEWGGDNWFDP

SEQ ID NO: 23247 - protein, 10 aa, Homo sapiens
  Light chain CDR3 for antibody 11624 (IGKV1-6)
LQDYNYPMYT

SEQ ID NO: 23248 - protein, 13 aa, Homo sapiens
  Heavy chain CDR3 for antibody 11624 (IGHV3-11)
ARDEGYSGYNLDN

SEQ ID NO: 23249 - protein, 9 aa, Homo sapiens
  Light chain CDR3 for antibody 11625 (IGKV1-39)
QQSYRTPLT

SEQ ID NO: 23250 - protein, 24 aa, Homo sapiens
  Heavy chain CDR3 for antibody 11625 (IGHV1-46)
ARDEARGLLTGYYNRREYYYGMDV

SEQ ID NO: 23251 - protein, 9 aa, Homo sapiens
  Light chain CDR3 for antibody 11626 (IGKV1-6)
LQDYKSPFT

SEQ ID NO: 23252 - protein, 12 aa, Homo sapiens
  Heavy chain CDR3 for antibody 11626 (IGHV4-39)
ARQMVREGWFDP

SEQ ID NO: 23253 - protein, 9 aa, Homo sapiens
  Light chain CDR3 for antibody 11627 (IGKV3D-7)
QQDYEFPIT

SEQ ID NO: 23254 - protein, 17 aa, Homo sapiens
  Heavy chain CDR3 for antibody 11627 (IGHV3-33)
ARVYYDILTGYSHAFDI

SEQ ID NO: 23255 - protein, 9 aa, Homo sapiens
  Light chain CDR3 for antibody 11628 (IGKV1-17)
QQLHIYPWT

SEQ ID NO: 23256 - protein, 15 aa, Homo sapiens
  Heavy chain CDR3 for antibody 11628 (IGHV3-33)
ARDHLTGYYYYGMDV

SEQ ID NO: 23257 - protein, 8 aa, Homo sapiens
  Light chain CDR3 for antibody 11629 (IGKV3-11)
QQRSNWLT

SEQ ID NO: 23258 - protein, 17 aa, Homo sapiens
  Heavy chain CDR3 for antibody 11629 (IGHV3-23)
AKDYDILTGYSHNWFDP

SEQ ID NO: 23259 - protein, 9 aa, Homo sapiens
  Light chain CDR3 for antibody 11630 (IGKV3-15)
QQYNDWPYT

SEQ ID NO: 23260 - protein, 13 aa, Homo sapiens
  Heavy chain CDR3 for antibody 11630 (IGHV3-23)
ASTGDSYYYGMDV

SEQ ID NO: 23261 - protein, 9 aa, Homo sapiens
  Light chain CDR3 for antibody 11631 (IGKV6-21)
HQSSSLPYT

SEQ ID NO: 23262 - protein, 13 aa, Homo sapiens
  Heavy chain CDR3 for antibody 11631 (IGHV4-39)
ARPGIVAAGWFDP

SEQ ID NO: 23263 - protein, 9 aa, Homo sapiens
  Light chain CDR3 for antibody 11632 (IGKV1D-16)
QQYNSYPYT

SEQ ID NO: 23264 - protein, 15 aa, Homo sapiens
  Heavy chain CDR3 for antibody 11632 (IGHV3-33)
ARDRGWKAPGYGMDA

SEQ ID NO: 23265 - protein, 9 aa, Homo sapiens
  Light chain CDR3 for antibody 11633 (IGKV3D-20)
QQYGSSPLT

SEQ ID NO: 23266 - protein, 12 aa, Homo sapiens
  Heavy chain CDR3 for antibody 11633 (IGHV1-18)
ARDDYYGSAFDY

SEQ ID NO: 23267 - protein, 9 aa, Homo sapiens
  Light chain CDR3 for antibody 11634 (IGKV1-9)
QQLNSYPYT

SEQ ID NO: 23268 - protein, 15 aa, Homo sapiens
  Heavy chain CDR3 for antibody 11634 (IGHV3-33)
ARDRVGVKDYYSMDV

SEQ ID NO: 23269 - protein, 8 aa, Homo sapiens
  Light chain CDR3 for antibody 11635 (IGKV1-5)
QQYNSYWT

SEQ ID NO: 23270 - protein, 20 aa, Homo sapiens
  Heavy chain CDR3 for antibody 11635 (IGHV1-f)
ATGLITFVRGVILTYRSFDY

SEQ ID NO: 23271 - protein, 10 aa, Homo sapiens
  Light chain CDR3 for antibody 11636 (IGKV1-6)
LQDYNYPMYT

SEQ ID NO: 23272 - protein, 14 aa, Homo sapiens
  Heavy chain CDR3 for antibody 11636 (IGHV3-33)
AKEGYSSNWYDFDY

SEQ ID NO: 23273 - protein, 9 aa, Homo sapiens
  Light chain CDR3 for antibody 11637 (IGKV1-9)
QQLHIYPWT

SEQ ID NO: 23274 - protein, 16 aa, Homo sapiens
  Heavy chain CDR3 for antibody 11637 (IGHV3-30)
ARDSSYYGSGYYGMDV

SEQ ID NO: 23275 - protein, 9 aa, Homo sapiens
  Light chain CDR3 for antibody 11638 (IGKV1D-13)
QHFNNYMYT

SEQ ID NO: 23276 - protein, 14 aa, Homo sapiens
  Heavy chain CDR3 for antibody 11638 (IGHV4-39)
ARQGGSGSYYNLDY

SEQ ID NO: 23277 - protein, 10 aa, Homo sapiens
  Light chain CDR3 for antibody 11639 (IGKV1-17)
LQHNSYPMYT

SEQ ID NO: 23278 - protein, 17 aa, Homo sapiens
  Heavy chain CDR3 for antibody 11639 (IGHV3-33)
ARDWFGELSDYYYGMDV

SEQ ID NO: 23279 - protein, 8 aa, Homo sapiens
  Light chain CDR3 for antibody 11640 (IGKV1-5)
QQYNSYWT

SEQ ID NO: 23280 - protein, 13 aa, Homo sapiens
  Heavy chain CDR3 for antibody 11640 (IGHV1-2)
ARDGVRGSFGMDV

SEQ ID NO: 23281 - protein, 10 aa, Homo sapiens
  Light chain CDR3 for antibody 11641 (IGKV1-17)
LQHNSYPMYT

SEQ ID NO: 23282 - protein, 18 aa, Homo sapiens
  Heavy chain CDR3 for antibody 11641 (IGHV3-23)
AKEGDYYGSGSYWGYFDP

SEQ ID NO: 23283 - protein, 10 aa, Homo sapiens
  Light chain CDR3 for antibody 11642 (IGKV1-17)
LQHNSYPMYT

SEQ ID NO: 23284 - protein, 17 aa, Homo sapiens
  Heavy chain CDR3 for antibody 11642 (IGHV3-23)
AKDRDWKDGYYYFGMDV

SEQ ID NO: 23285 - protein, 8 aa, Homo sapiens
  Light chain CDR3 for antibody 11643 (IGKV3-11)
QQRGNWPS

SEQ ID NO: 23286 - protein, 11 aa, Homo sapiens
  Heavy chain CDR3 for antibody 11643 (IGHV3-23)
AKGLWSYYFDY

SEQ ID NO: 23287 - protein, 9 aa, Homo sapiens
  Light chain CDR3 for antibody 11644 (IGKV1-27)
QKYNSAPYT

SEQ ID NO: 23288 - protein, 15 aa, Homo sapiens
  Heavy chain CDR3 for antibody 11644 (IGHV3-23)
AKDRYFDWLPDAFDI

SEQ ID NO: 23289 - protein, 9 aa, Homo sapiens
  Light chain CDR3 for antibody 11645 (IGKV1-6)
LQVYSYPWT

SEQ ID NO: 23290 - protein, 16 aa, Homo sapiens
  Heavy chain CDR3 for antibody 11645 (IGHV3-33)
ARSPYDILTGYPHFDY

SEQ ID NO: 23291 - protein, 8 aa, Homo sapiens
  Light chain CDR3 for antibody 11646 (IGKV6-21)
HQSSSLPT

SEQ ID NO: 23292 - protein, 13 aa, Homo sapiens
  Heavy chain CDR3 for antibody 11646 (IGHV3-33)
ARVDTMVRGVMAY

SEQ ID NO: 23293 - protein, 10 aa, Homo sapiens
  Light chain CDR3 for antibody 11647 (IGKV1-9)
QQLDSYPMYT

SEQ ID NO: 23294 - protein, 13 aa, Homo sapiens
  Heavy chain CDR3 for antibody 11647 (IGHV3-33)
ARDWGYSHGYFDY

SEQ ID NO: 23295 - protein, 9 aa, Homo sapiens
  Light chain CDR3 for antibody 11648 (IGKV1-9)
QQLISYPLT

SEQ ID NO: 23296 - protein, 14 aa, Homo sapiens
  Heavy chain CDR3 for antibody 11648 (IGHV3-33)
ARDGLVGASSWFDP

SEQ ID NO: 23297 - protein, 8 aa, Homo sapiens
  Light chain CDR3 for antibody 11649 (IGKV1-5)
QQYNSYYT

SEQ ID NO: 23298 - protein, 14 aa, Homo sapiens
  Heavy chain CDR3 for antibody 11649 (IGHV3-20)
ARDRGSSFFDAFDI

SEQ ID NO: 23299 - protein, 9 aa, Homo sapiens
  Light chain CDR3 for antibody 11650 (IGKV5-2)
LQHDKFPYT

SEQ ID NO: 23300 - protein, 17 aa, Homo sapiens
  Heavy chain CDR3 for antibody 11650 (IGHV3-33)
ARSMVTTYGYYYYGMDV

SEQ ID NO: 23301 - protein, 8 aa, Homo sapiens
  Light chain CDR3 for antibody 11651 (IGKV3D-7)
QQDYNLYT

SEQ ID NO: 23302 - protein, 17 aa, Homo sapiens
  Heavy chain CDR3 for antibody 11651 (IGHV3-33)
ARWAPMVRGLNYYGMDV

SEQ ID NO: 23303 - protein, 9 aa, Homo sapiens
  Light chain CDR3 for antibody 11652 (IGKV4-1)
QQYYSTPLT

SEQ ID NO: 23304 - protein, 12 aa, Homo sapiens
  Heavy chain CDR3 for antibody 11652 (IGHV3-21)
AREGFGESSFDY

SEQ ID NO: 23305 - protein, 10 aa, Homo sapiens
  Light chain CDR3 for antibody 11653 (IGKV3-11)
QQRSNWPALT

SEQ ID NO: 23306 - protein, 16 aa, Homo sapiens
  Heavy chain CDR3 for antibody 11653 (IGHV3-23)
ARDLGIAAAGTGWFDP

SEQ ID NO: 23307 - protein, 9 aa, Homo sapiens
  Light chain CDR3 for antibody 11654 (IGKV3-15)
QQYNNWPYT

SEQ ID NO: 23308 - protein, 10 aa, Homo sapiens
  Heavy chain CDR3 for antibody 11654 (IGHV3-23)
ATIVGHFLDV

SEQ ID NO: 23309 - protein, 9 aa, Homo sapiens
  Light chain CDR3 for antibody 11655 (IGKV3-20)
QQYGSSPYT

SEQ ID NO: 23310 - protein, 9 aa, Homo sapiens
  Heavy chain CDR3 for antibody 11655 (IGHV3-33)
ARATGGVDY

SEQ ID NO: 23311 - protein, 9 aa, Homo sapiens
  Light chain CDR3 for antibody 11656 (IGKV1D-13)
QRFNNYLYT

SEQ ID NO: 23312 - protein, 8 aa, Homo sapiens
  Heavy chain CDR3 for antibody 11656 (IGHV3-23)
AETFLFDY

SEQ ID NO: 23313 - protein, 8 aa, Homo sapiens
  Light chain CDR3 for antibody 11657 (IGKV1D-13)
QQFNNYPT

SEQ ID NO: 23314 - protein, 13 aa, Homo sapiens
  Heavy chain CDR3 for antibody 11657 (IGHV3-21)
ATGAWASSWWGDY

SEQ ID NO: 23315 - protein, 8 aa, Homo sapiens
  Light chain CDR3 for antibody 11658 (IGKV3D-7)
QQDYNLLT

SEQ ID NO: 23316 - protein, 18 aa, Homo sapiens
  Heavy chain CDR3 for antibody 11658 (IGHV3-33)
VREGGYYGSGSYPDAFDI

SEQ ID NO: 23317 - protein, 10 aa, Homo sapiens
  Light chain CDR3 for antibody 11659 (IGKV1-17)
LQHNSYPMYT

SEQ ID NO: 23318 - protein, 13 aa, Homo sapiens
  Heavy chain CDR3 for antibody 11659 (IGHV3-33)
ARGVLWFGELFDY

SEQ ID NO: 23319 - protein, 9 aa, Homo sapiens
  Light chain CDR3 for antibody 11660 (IGKV1-6)
LQDYKSPFT

SEQ ID NO: 23320 - protein, 18 aa, Homo sapiens
  Heavy chain CDR3 for antibody 11660 (IGHV3-33)
ARGLLWFGVSYYYYGMDV

SEQ ID NO: 23321 - protein, 9 aa, Homo sapiens
  Light chain CDR3 for antibody 11661 (IGKV1-39)
QQSYSTPYT

SEQ ID NO: 23322 - protein, 22 aa, Homo sapiens
  Heavy chain CDR3 for antibody 11661 (IGHV3-11)
AREAYYDILTGYSLYYYYGMDV

SEQ ID NO: 23323 - protein, 9 aa, Homo sapiens
  Light chain CDR3 for antibody 11662 (IGKV3D-7)
QQDYELPLT

SEQ ID NO: 23324 - protein, 14 aa, Homo sapiens
  Heavy chain CDR3 for antibody 11662 (IGHV1-46)
ARDGVGAKEGGFDY

SEQ ID NO: 23325 - protein, 9 aa, Homo sapiens
  Light chain CDR3 for antibody 11663 (IGKV1D-13)
QQFNNYPYT

SEQ ID NO: 23326 - protein, 14 aa, Homo sapiens
  Heavy chain CDR3 for antibody 11663 (IGHV3-33)
ARDTVAAGFNGMDV

SEQ ID NO: 23327 - protein, 8 aa, Homo sapiens
  Light chain CDR3 for antibody 11664 (IGKV3-11)
QQRSNWLT

SEQ ID NO: 23328 - protein, 18 aa, Homo sapiens
  Heavy chain CDR3 for antibody 11664 (IGHV3-33)
ARREGITMIFYYYYGMDV

SEQ ID NO: 23329 - protein, 9 aa, Homo sapiens
  Light chain CDR3 for antibody 11665 (IGKV1-6)
QQLHIYPWT

SEQ ID NO: 23330 - protein, 17 aa, Homo sapiens
  Heavy chain CDR3 for antibody 11665 (IGHV1-18)
ARERYYGSGIYKYAMDV

SEQ ID NO: 23331 - protein, 9 aa, Homo sapiens
  Light chain CDR3 for antibody 11666 (IGKV3-20)
QQYGSSPYT

SEQ ID NO: 23332 - protein, 11 aa, Homo sapiens
  Heavy chain CDR3 for antibody 11666 (IGHV3-23)
GEFSSGWSFDY

SEQ ID NO: 23333 - protein, 9 aa, Homo sapiens
  Light chain CDR3 for antibody 11667 (IGKV1D-13)
QQFNNYPYT

SEQ ID NO: 23334 - protein, 12 aa, Homo sapiens
  Heavy chain CDR3 for antibody 11667 (IGHV3-33)
ARNYDILDYFDY

SEQ ID NO: 23335 - protein, 9 aa, Homo sapiens
  Light chain CDR3 for antibody 11668 (IGKV3D-7)
QQDYNLPYS

SEQ ID NO: 23336 - protein, 13 aa, Homo sapiens
  Heavy chain CDR3 for antibody 11668 (IGHV1-46)
ARVKLGSLGAFDI

SEQ ID NO: 23337 - protein, 10 aa, Homo sapiens
  Light chain CDR3 for antibody 11669 (IGKV1-17)
QQYNSYPMYT

SEQ ID NO: 23338 - protein, 18 aa, Homo sapiens
  Heavy chain CDR3 for antibody 11669 (IGHV3-33)
ARDRHHDILTGYSDAFEI

SEQ ID NO: 23339 - protein, 9 aa, Homo sapiens
  Light chain CDR3 for antibody 11670 (IGKV2-30)
MQGTHWPLT

SEQ ID NO: 23340 - protein, 18 aa, Homo sapiens
  Heavy chain CDR3 for antibody 11670 (IGHV1-18)
ARDPTFYYVSGSYYKFDY

SEQ ID NO: 23341 - protein, 9 aa, Homo sapiens
  Light chain CDR3 for antibody 11671 (IGKV1-6)
QQYNSYPYT

SEQ ID NO: 23342 - protein, 18 aa, Homo sapiens
  Heavy chain CDR3 for antibody 11671 (IGHV4-59)
AREGDYVWGSYRPDCFDH

SEQ ID NO: 23343 - protein, 8 aa, Homo sapiens
  Light chain CDR3 for antibody 11672 (IGKV3-11)
QQRSNWLT

SEQ ID NO: 23344 - protein, 13 aa, Homo sapiens
  Heavy chain CDR3 for antibody 11672 (IGHV3-23)
AKDRGLRYYGMDV

SEQ ID NO: 23345 - protein, 10 aa, Homo sapiens
  Light chain CDR3 for antibody 11673 (IGKV3-11)
QQRSNWLMYT

SEQ ID NO: 23346 - protein, 18 aa, Homo sapiens
  Heavy chain CDR3 for antibody 11673 (IGHV3-33)
ARGYYGSGNFYKDSGMDV

SEQ ID NO: 23347 - protein, 9 aa, Homo sapiens
  Light chain CDR3 for antibody 11674 (IGKV3-15)
QQYNNWPRT

SEQ ID NO: 23348 - protein, 14 aa, Homo sapiens
  Heavy chain CDR3 for antibody 11674 (IGHV1-18)
ARDQPTVPSGYFDY

SEQ ID NO: 23349 - protein, 8 aa, Homo sapiens
  Light chain CDR3 for antibody 11675 (IGKV3-11)
QQRSNWWT

SEQ ID NO: 23350 - protein, 14 aa, Homo sapiens
  Heavy chain CDR3 for antibody 11675 (IGHV4-39)
ARDSGYDYYYGMDV

SEQ ID NO: 23351 - protein, 9 aa, Homo sapiens
  Light chain CDR3 for antibody 11676 (IGKV5-2)
LQHDKFPYT

SEQ ID NO: 23352 - protein, 13 aa, Homo sapiens
  Heavy chain CDR3 for antibody 11676 (IGHV3-53)
AREGIAVAGDFDF

SEQ ID NO: 23353 - protein, 9 aa, Homo sapiens
  Light chain CDR3 for antibody 11677 (IGKV1-6)
LQDFNYPRT

SEQ ID NO: 23354 - protein, 18 aa, Homo sapiens
  Heavy chain CDR3 for antibody 11677 (IGHV3-33)
ARDQGIVVLPGAPWYFDL

SEQ ID NO: 23355 - protein, 8 aa, Homo sapiens
  Light chain CDR3 for antibody 11678 (IGKV6-21)
HQSSSLPT

SEQ ID NO: 23356 - protein, 14 aa, Homo sapiens
  Heavy chain CDR3 for antibody 11678 (IGHV3-33)
ARRGYSGYDWYFDY

SEQ ID NO: 23357 - protein, 9 aa, Homo sapiens
  Light chain CDR3 for antibody 11679 (IGKV1-17)
LQHNSYPRT

SEQ ID NO: 23358 - protein, 16 aa, Homo sapiens
  Heavy chain CDR3 for antibody 11679 (IGHV1-46)
ARGGGYSESYSNWFDP

SEQ ID NO: 23359 - protein, 9 aa, Homo sapiens
  Light chain CDR3 for antibody 11680 (IGKV2D-28)
MQALQTPPT

SEQ ID NO: 23360 - protein, 9 aa, Homo sapiens
  Heavy chain CDR3 for antibody 11680 (IGHV4-59)
AGGSWDFDY

SEQ ID NO: 23361 - protein, 9 aa, Homo sapiens
  Light chain CDR3 for antibody 11681 (IGKV1-17)
LQHNTYPYT

SEQ ID NO: 23362 - protein, 13 aa, Homo sapiens
  Heavy chain CDR3 for antibody 11681 (IGHV4-61)
ASRYSSGWYPFDY

SEQ ID NO: 23363 - protein, 8 aa, Homo sapiens
  Light chain CDR3 for antibody 11682 (IGKV1-5)
QQYNSYST

SEQ ID NO: 23364 - protein, 17 aa, Homo sapiens
  Heavy chain CDR3 for antibody 11682 (IGHV3-23)
AKDRDWKDGYYYFGMDV

SEQ ID NO: 23365 - protein, 10 aa, Homo sapiens
  Light chain CDR3 for antibody 11683 (IGKV1-9)
QQLNSFLMYT

SEQ ID NO: 23366 - protein, 14 aa, Homo sapiens
  Heavy chain CDR3 for antibody 11683 (IGHV3-23)
AKSRIVGALYYFDY

SEQ ID NO: 23367 - protein, 9 aa, Homo sapiens
  Light chain CDR3 for antibody 11684 (IGKV3-15)
QQYHNWPYT

SEQ ID NO: 23368 - protein, 15 aa, Homo sapiens
  Heavy chain CDR3 for antibody 11684 (IGHV3-33)
ARDALAVTGTGWFDP

SEQ ID NO: 23369 - protein, 9 aa, Homo sapiens
  Light chain CDR3 for antibody 11685 (IGKV1-17)
LQHNSYPIT

SEQ ID NO: 23370 - protein, 18 aa, Homo sapiens
  Heavy chain CDR3 for antibody 11685 (IGHV3-23)
AREYYDFLTGYYKGAFDI

SEQ ID NO: 23371 - protein, 9 aa, Homo sapiens
  Light chain CDR3 for antibody 11686 (IGKV3-15)
QQYINWPLT

SEQ ID NO: 23372 - protein, 24 aa, Homo sapiens
  Heavy chain CDR3 for antibody 11686 (IGHV1-46)
ARDEARGLLTGYYNMREYYYGMDV

SEQ ID NO: 23373 - protein, 9 aa, Homo sapiens
  Light chain CDR3 for antibody 11687 (IGKV4-1)
QQYYTTPPT

SEQ ID NO: 23374 - protein, 14 aa, Homo sapiens
  Heavy chain CDR3 for antibody 11687 (IGHV3-33)
ARDREQQLVRYFDY

SEQ ID NO: 23375 - protein, 9 aa, Homo sapiens
  Light chain CDR3 for antibody 11688 (IGKV1D-16)
QQYSSYPYT

SEQ ID NO: 23376 - protein, 12 aa, Homo sapiens
  Heavy chain CDR3 for antibody 11688 (IGHV3-33)
AREMGGSYEVDY

SEQ ID NO: 23377 - protein, 9 aa, Homo sapiens
  Light chain CDR3 for antibody 11689 (IGKV3D-20)
QQYGSSPYT

SEQ ID NO: 23378 - protein, 13 aa, Homo sapiens
  Heavy chain CDR3 for antibody 11689 (IGHV3-20)
AREGGYNFGPFDY

SEQ ID NO: 23379 - protein, 9 aa, Homo sapiens
  Light chain CDR3 for antibody 11690 (IGKV5-2)
LQHDNFPWA

SEQ ID NO: 23380 - protein, 18 aa, Homo sapiens
  Heavy chain CDR3 for antibody 11690 (IGHV1-18)
ARDRGYYYGSGSYSPFDY

SEQ ID NO: 23381 - protein, 10 aa, Homo sapiens
  Light chain CDR3 for antibody 11691 (IGKV3-20)
QQYGSSPPYT

SEQ ID NO: 23382 - protein, 13 aa, Homo sapiens
  Heavy chain CDR3 for antibody 11691 (IGHV3-33)
ARDQRYSSGWYDY

SEQ ID NO: 23383 - protein, 9 aa, Homo sapiens
  Light chain CDR3 for antibody 11692 (IGKV1-17)
LQHNSYPYT

SEQ ID NO: 23384 - protein, 16 aa, Homo sapiens
  Heavy chain CDR3 for antibody 11692 (IGHV4-61)
ARDPRYSSGWYWYFDL

SEQ ID NO: 23385 - protein, 9 aa, Homo sapiens
  Light chain CDR3 for antibody 11693 (IGKV1-17)
LQHNSYPYT

SEQ ID NO: 23386 - protein, 13 aa, Homo sapiens
  Heavy chain CDR3 for antibody 11693 (IGHV3-33)
ARDRDSSGSYFDY

SEQ ID NO: 23387 - protein, 9 aa, Homo sapiens
  Light chain CDR3 for antibody 11694 (IGKV3-11)
QQRSNWPPT

SEQ ID NO: 23388 - protein, 13 aa, Homo sapiens
  Heavy chain CDR3 for antibody 11694 (IGHV3-33)
ARDYGDYLNWFDP

SEQ ID NO: 23389 - protein, 9 aa, Homo sapiens
  Light chain CDR3 for antibody 11695 (IGKV6-21)
QQSSSLPRT

SEQ ID NO: 23390 - protein, 16 aa, Homo sapiens
  Heavy chain CDR3 for antibody 11695 (IGHV3-23)
AKEGMVLRYFDWFWDY

SEQ ID NO: 23391 - protein, 9 aa, Homo sapiens
  Light chain CDR3 for antibody 11696 (IGKV3-11)
QQRSSWPPT

SEQ ID NO: 23392 - protein, 20 aa, Homo sapiens
  Heavy chain CDR3 for antibody 11696 (IGHV3-33)
SRGGATSVRGVIDYYYGMDV

SEQ ID NO: 23393 - protein, 8 aa, Homo sapiens
  Light chain CDR3 for antibody 11697 (IGKV3-20)
QQYGRSWT

SEQ ID NO: 23394 - protein, 13 aa, Homo sapiens
  Heavy chain CDR3 for antibody 11697 (IGHV3-33)
ARTDYYYYYGLDV

SEQ ID NO: 23395 - protein, 10 aa, Homo sapiens
  Light chain CDR3 for antibody 11698 (IGKV3-20)
QQYGSSPPYT

SEQ ID NO: 23396 - protein, 12 aa, Homo sapiens
  Heavy chain CDR3 for antibody 11698 (IGHV4-59)
ARDRSGWAYFDY

SEQ ID NO: 23397 - protein, 9 aa, Homo sapiens
  Light chain CDR3 for antibody 11699 (IGKV1-17)
QQLNSYPLT

SEQ ID NO: 23398 - protein, 17 aa, Homo sapiens
  Heavy chain CDR3 for antibody 11699 (IGHV3-33)
AREGTMVRGYYYYGMDV

SEQ ID NO: 23399 - protein, 9 aa, Homo sapiens
  Light chain CDR3 for antibody 11700 (IGKV1-17)
LHSNNYPWT

SEQ ID NO: 23400 - protein, 14 aa, Homo sapiens
  Heavy chain CDR3 for antibody 11700 (IGHV3-33)
AREGYSSNWYDFDY

SEQ ID NO: 23401 - protein, 9 aa, Homo sapiens
  Light chain CDR3 for antibody 11701 (IGKV1-16)
QQYDSYPWT

SEQ ID NO: 23402 - protein, 22 aa, Homo sapiens
  Heavy chain CDR3 for antibody 11701 (IGHV4-59)
AREINYGAGSYYNEDYYYGMDV

SEQ ID NO: 23403 - protein, 9 aa, Homo sapiens
  Light chain CDR3 for antibody 11702 (IGKV2-30)
MQGTHWPLT

SEQ ID NO: 23404 - protein, 14 aa, Homo sapiens
  Heavy chain CDR3 for antibody 11702 (IGHV3-33)
ARDGIVRATDAFAI

SEQ ID NO: 23405 - protein, 10 aa, Homo sapiens
  Light chain CDR3 for antibody 11703 (IGKV3-11)
QQRSNWPILT

SEQ ID NO: 23406 - protein, 10 aa, Homo sapiens
  Heavy chain CDR3 for antibody 11703 (IGHV3-23)
AKDQVGATDC

SEQ ID NO: 23407 - protein, 8 aa, Homo sapiens
  Light chain CDR3 for antibody 11704 (IGKV3-11)
QQRSNWWT

SEQ ID NO: 23408 - protein, 15 aa, Homo sapiens
  Heavy chain CDR3 for antibody 11704 (IGHV3-33)
ARDTGYSSSWNWFDP

SEQ ID NO: 23409 - protein, 9 aa, Homo sapiens
  Light chain CDR3 for antibody 11705 (IGKV6-21)
HQSSSLPYT

SEQ ID NO: 23410 - protein, 12 aa, Homo sapiens
  Heavy chain CDR3 for antibody 11705 (IGHV3-66)
VRDRAAAPYFDL

SEQ ID NO: 23411 - protein, 9 aa, Homo sapiens
  Light chain CDR3 for antibody 11706 (IGKV1-6)
LQDYNYPYT

SEQ ID NO: 23412 - protein, 17 aa, Homo sapiens
  Heavy chain CDR3 for antibody 11706 (IGHV3-33)
ARGGATLIRGVDYGMDV

SEQ ID NO: 23413 - protein, 9 aa, Homo sapiens
  Light chain CDR3 for antibody 11707 (IGKV1-6)
LQDYNYPYT

SEQ ID NO: 23414 - protein, 17 aa, Homo sapiens
  Heavy chain CDR3 for antibody 11707 (IGHV4-59)
ARRDYVWGSYRPDWFDP

SEQ ID NO: 23415 - protein, 10 aa, Homo sapiens
  Light chain CDR3 for antibody 11708 (IGKV1-17)
QQRSNWPALT

SEQ ID NO: 23416 - protein, 16 aa, Homo sapiens
  Heavy chain CDR3 for antibody 11708 (IGHV4-59)
ARDTPYYSGSGRPFDH

SEQ ID NO: 23417 - protein, 11 aa, Homo sapiens
  Light chain CDR3 for antibody 11709 (IGKV3-11)
QQRINWPPTWT

SEQ ID NO: 23418 - protein, 13 aa, Homo sapiens
  Heavy chain CDR3 for antibody 11709 (IGHV3-11)
ARDEGYSGYNLDN

SEQ ID NO: 23419 - protein, 9 aa, Homo sapiens
  Light chain CDR3 for antibody 11710 (IGKV1-33)
QQYDNLPFT

SEQ ID NO: 23420 - protein, 15 aa, Homo sapiens
  Heavy chain CDR3 for antibody 11710 (IGHV3-33)
ARDRGMVRGDGYLDY

SEQ ID NO: 23421 - protein, 8 aa, Homo sapiens
  Light chain CDR3 for antibody 11711 (IGKV1-5)
QQYNSYWT

SEQ ID NO: 23422 - protein, 12 aa, Homo sapiens
  Heavy chain CDR3 for antibody 11711 (IGHV3-33)
ARDYGSGSFFDY

SEQ ID NO: 23423 - protein, 9 aa, Homo sapiens
  Light chain CDR3 for antibody 11712 (IGKV3-15)
QQYNNWPYT

SEQ ID NO: 23424 - protein, 19 aa, Homo sapiens
  Heavy chain CDR3 for antibody 11712 (IGHV3-33)
ARGVRLRFFDAYYYYGLDV

SEQ ID NO: 23425 - protein, 10 aa, Homo sapiens
  Light chain CDR3 for antibody 11713 (IGKV3-11)
QQRSTWPTLT

SEQ ID NO: 23426 - protein, 15 aa, Homo sapiens
  Heavy chain CDR3 for antibody 11713 (IGHV3-33)
ARDTGYSSSWNWFDP

SEQ ID NO: 23427 - protein, 8 aa, Homo sapiens
  Light chain CDR3 for antibody 11714 (IGKV3-11)
QQRSNWLT

SEQ ID NO: 23428 - protein, 14 aa, Homo sapiens
  Heavy chain CDR3 for antibody 11714 (IGHV3-33)
ARDRIAAASSDFDC

SEQ ID NO: 23429 - protein, 10 aa, Homo sapiens
  Light chain CDR3 for antibody 11715 (IGKV3-11)
QQRSNWPALT

SEQ ID NO: 23430 - protein, 14 aa, Homo sapiens
  Heavy chain CDR3 for antibody 11715 (IGHV4-39)
ARQGGSGSYYNLDY

SEQ ID NO: 23431 - protein, 9 aa, Homo sapiens
  Light chain CDR3 for antibody 11716 (IGKV3-11)
QQRSSWPPT

SEQ ID NO: 23432 - protein, 18 aa, Homo sapiens
  Heavy chain CDR3 for antibody 11716 (IGHV3-13)
ARDYYGSGSLYYYYGMDV

SEQ ID NO: 23433 - protein, 9 aa, Homo sapiens
  Light chain CDR3 for antibody 11717 (IGKV3-20)
QQYGSSPYT

SEQ ID NO: 23434 - protein, 16 aa, Homo sapiens
  Heavy chain CDR3 for antibody 11717 (IGHV2-70)
AHRAVVTSNLNCRFDF

SEQ ID NO: 23435 - protein, 9 aa, Homo sapiens
  Light chain CDR3 for antibody 11718 (IGKV1-6)
LQDYNYPRT

SEQ ID NO: 23436 - protein, 5 aa, Homo sapiens
  Heavy chain CDR3 for antibody 11718 (IGHV3-33)
ARGLE

SEQ ID NO: 23437 - protein, 10 aa, Homo sapiens
  Light chain CDR3 for antibody 11719 (IGKV3-20)
QQYGRSPPVT

SEQ ID NO: 23438 - protein, 12 aa, Homo sapiens
  Heavy chain CDR3 for antibody 11719 (IGHV3-13)
VREAGIPDAFDI

SEQ ID NO: 23439 - protein, 11 aa, Homo sapiens
  Light chain CDR3 for antibody 11720 (IGKV3-11)
QQRSNWPPTWT

SEQ ID NO: 23440 - protein, 9 aa, Homo sapiens
  Heavy chain CDR3 for antibody 11720 (IGHV3-33)
AREKAYFDY

SEQ ID NO: 23441 - protein, 8 aa, Homo sapiens
  Light chain CDR3 for antibody 11721 (IGKV1D-13)
QQFNNYPT

SEQ ID NO: 23442 - protein, 16 aa, Homo sapiens
  Heavy chain CDR3 for antibody 11721 (IGHV4-59)
ARFYFGSGSYYWYFDL

SEQ ID NO: 23443 - protein, 8 aa, Homo sapiens
  Light chain CDR3 for antibody 11722 (IGKV3-11)
QQRGNWPS

SEQ ID NO: 23444 - protein, 18 aa, Homo sapiens
  Heavy chain CDR3 for antibody 11722 (IGHV4-59)
AREGDYVWGSYRPNWFDP

SEQ ID NO: 23445 - protein, 9 aa, Homo sapiens
  Light chain CDR3 for antibody 11723 (IGKV3-20)
QQYGSSPYT

SEQ ID NO: 23446 - protein, 20 aa, Homo sapiens
  Heavy chain CDR3 for antibody 11723 (IGHV4-59)
AREQVLWFGDLPYYYYGMDV

SEQ ID NO: 23447 - protein, 10 aa, Homo sapiens
  Light chain CDR3 for antibody 11724 (IGKV1-9)
QQLDSYPMYT

SEQ ID NO: 23448 - protein, 8 aa, Homo sapiens
  Heavy chain CDR3 for antibody 11724 (IGHV3-23)
AKETGNDY

SEQ ID NO: 23449 - protein, 8 aa, Homo sapiens
  Light chain CDR3 for antibody 11725 (IGKV1-6)
LQDYNYYT

SEQ ID NO: 23450 - protein, 13 aa, Homo sapiens
  Heavy chain CDR3 for antibody 11725 (IGHV3-23)
AKDRGYSSTSTAY

SEQ ID NO: 23451 - protein, 9 aa, Homo sapiens
  Light chain CDR3 for antibody 11726 (IGKV2-30)
MQGTHWPYT

SEQ ID NO: 23452 - protein, 18 aa, Homo sapiens
  Heavy chain CDR3 for antibody 11726 (IGHV4-59)
ARERGNWNDVDYYYGMDV

SEQ ID NO: 23453 - protein, 9 aa, Homo sapiens
  Light chain CDR3 for antibody 11727 (IGKV1-17)
LHSNNYPWT

SEQ ID NO: 23454 - protein, 13 aa, Homo sapiens
  Heavy chain CDR3 for antibody 11727 (IGHV3-33)
ARDQRYSSGWYDY

SEQ ID NO: 23455 - protein, 8 aa, Homo sapiens
  Light chain CDR3 for antibody 11728 (IGKV3-11)
QQRSNWLT

SEQ ID NO: 23456 - protein, 11 aa, Homo sapiens
  Heavy chain CDR3 for antibody 11728 (IGHV3-33)
ARDRGNWGFDY

SEQ ID NO: 23457 - protein, 9 aa, Homo sapiens
  Light chain CDR3 for antibody 11729 (IGKV1-33)
QQYDNLPPT

SEQ ID NO: 23458 - protein, 17 aa, Homo sapiens
  Heavy chain CDR3 for antibody 11729 (IGHV1-24)
ATHYGSGSHYKGYGMDV

SEQ ID NO: 23459 - protein, 10 aa, Homo sapiens
  Light chain CDR3 for antibody 11730 (IGKV3-20)
QQYGSSPPYT

SEQ ID NO: 23460 - protein, 15 aa, Homo sapiens
  Heavy chain CDR3 for antibody 11730 (IGHV3-23)
AKDRDYDFLSGPFDY

SEQ ID NO: 23461 - protein, 9 aa, Homo sapiens
  Light chain CDR3 for antibody 11731 (IGKV1D-16)
QQYNSFPLT

SEQ ID NO: 23462 - protein, 18 aa, Homo sapiens
  Heavy chain CDR3 for antibody 11731 (IGHV1-18)
ARDRYYYDSGSYYYGTDV

SEQ ID NO: 23463 - protein, 8 aa, Homo sapiens
  Light chain CDR3 for antibody 11732 (IGKV3-20)
QQYGSSFT

SEQ ID NO: 23464 - protein, 18 aa, Homo sapiens
  Heavy chain CDR3 for antibody 11732 (IGHV1-18)
ARDRYYYDSGSYYYGMDV

SEQ ID NO: 23465 - protein, 9 aa, Homo sapiens
  Light chain CDR3 for antibody 11733 (IGKV1-6)
LQDYNYTWT

SEQ ID NO: 23466 - protein, 21 aa, Homo sapiens
  Heavy chain CDR3 for antibody 11733 (IGHV3-23)
AKDIEYYGSGSYPLYYYGMDV

SEQ ID NO: 23467 - protein, 9 aa, Homo sapiens
  Light chain CDR3 for antibody 11734 (IGKV3D-7)
QQDYKLPLT

SEQ ID NO: 23468 - protein, 9 aa, Homo sapiens
  Heavy chain CDR3 for antibody 11734 (IGHV4-59)
ARSGSGIYT

SEQ ID NO: 23469 - protein, 10 aa, Homo sapiens
  Light chain CDR3 for antibody 11735 (IGKV3-20)
QQYGSSPPYT

SEQ ID NO: 23470 - protein, 12 aa, Homo sapiens
  Heavy chain CDR3 for antibody 11735 (IGHV3-33)
AREGTGGNWFDP

SEQ ID NO: 23471 - protein, 9 aa, Homo sapiens
  Light chain CDR3 for antibody 11736 (IGKV1-17)
LQHNSYPYT

SEQ ID NO: 23472 - protein, 22 aa, Homo sapiens
  Heavy chain CDR3 for antibody 11736 (IGHV1-46)
ARDRYNNQSKYRNRDYYYGLDV

SEQ ID NO: 23473 - protein, 9 aa, Homo sapiens
  Light chain CDR3 for antibody 11737 (IGKV1D-16)
QQYISYPYT

SEQ ID NO: 23474 - protein, 14 aa, Homo sapiens
  Heavy chain CDR3 for antibody 11737 (IGHV1-18)
ARERYYGSGSPFDY

SEQ ID NO: 23475 - protein, 9 aa, Homo sapiens
  Light chain CDR3 for antibody 11738 (IGKV1-17)
LHSNNYPWT

SEQ ID NO: 23476 - protein, 13 aa, Homo sapiens
  Heavy chain CDR3 for antibody 11738 (IGHV3-33)
ARRYRSGWYPFDY

SEQ ID NO: 23477 - protein, 9 aa, Homo sapiens
  Light chain CDR3 for antibody 11739 (IGKV6-21)
HQSTSLPFT

SEQ ID NO: 23478 - protein, 11 aa, Homo sapiens
  Heavy chain CDR3 for antibody 11739 (IGHV3-33)
ARDRVLTPFDY

SEQ ID NO: 23479 - protein, 9 aa, Homo sapiens
  Light chain CDR3 for antibody 11740 (IGKV1-16)
QQYACYPPT

SEQ ID NO: 23480 - protein, 16 aa, Homo sapiens
  Heavy chain CDR3 for antibody 11740 (IGHV3-33)
ARDNFGSGSYYSHFHY

SEQ ID NO: 23481 - protein, 9 aa, Homo sapiens
  Light chain CDR3 for antibody 11741 (IGKV1D-16)
QQYHSYPYT

SEQ ID NO: 23482 - protein, 16 aa, Homo sapiens
  Heavy chain CDR3 for antibody 11741 (IGHV3-33)
ARIAAPGSEYYYGMDV

SEQ ID NO: 23483 - protein, 9 aa, Homo sapiens
  Light chain CDR3 for antibody 11742 (IGKV1D-16)
QQYSSYPYT

SEQ ID NO: 23484 - protein, 14 aa, Homo sapiens
  Heavy chain CDR3 for antibody 11742 (IGHV3-23)
AKSRIVGALYYFGY

SEQ ID NO: 23485 - protein, 9 aa, Homo sapiens
  Light chain CDR3 for antibody 11743 (IGKV1D-16)
QQYNSFPLT

SEQ ID NO: 23486 - protein, 17 aa, Homo sapiens
  Heavy chain CDR3 for antibody 11743 (IGHV4-59)
ARRIPMVREIIITAFDY

SEQ ID NO: 23487 - protein, 9 aa, Homo sapiens
  Light chain CDR3 for antibody 11744 (IGKV1-5)
QQYDSYPWT

SEQ ID NO: 23488 - protein, 13 aa, Homo sapiens
  Heavy chain CDR3 for antibody 11744 (IGHV3-23)
ASPFNWNDGFFDY

SEQ ID NO: 23489 - protein, 10 aa, Homo sapiens
  Light chain CDR3 for antibody 11745 (IGKV3-15)
QQYNNWPPLT

SEQ ID NO: 23490 - protein, 18 aa, Homo sapiens
  Heavy chain CDR3 for antibody 11745 (IGHV1-18)
ARDPNYYGSGSYYNYFDY

SEQ ID NO: 23491 - protein, 8 aa, Homo sapiens
  Light chain CDR3 for antibody 11746 (IGKV1D-13)
QQFNNYPT

SEQ ID NO: 23492 - protein, 15 aa, Homo sapiens
  Heavy chain CDR3 for antibody 11746 (IGHV3-33)
ARDRGMVRGDGYLDY

SEQ ID NO: 23493 - protein, 9 aa, Homo sapiens
  Light chain CDR3 for antibody 11747 (IGKV1-37)
QRTSNAPYT

SEQ ID NO: 23494 - protein, 18 aa, Homo sapiens
  Heavy chain CDR3 for antibody 11747 (IGHV3-33)
ARDGYSGYDYYYYYGMDV

SEQ ID NO: 23495 - protein, 8 aa, Homo sapiens
  Light chain CDR3 for antibody 11748 (IGKV3-20)
QQYGRSFT

SEQ ID NO: 23496 - protein, 18 aa, Homo sapiens
  Heavy chain CDR3 for antibody 11748 (IGHV3-33)
ARGLLWFGVSYYYYGMDV

SEQ ID NO: 23497 - protein, 9 aa, Homo sapiens
  Light chain CDR3 for antibody 11749 (IGKV1-27)
QKYNSAPYT

SEQ ID NO: 23498 - protein, 22 aa, Homo sapiens
  Heavy chain CDR3 for antibody 11749 (IGHV3-33)
ARMYYDILTGYYKDYYYYGMDV

SEQ ID NO: 23499 - protein, 8 aa, Homo sapiens
  Light chain CDR3 for antibody 11750 (IGKV1-5)
QQYNSYST

SEQ ID NO: 23500 - protein, 18 aa, Homo sapiens
  Heavy chain CDR3 for antibody 11750 (IGHV3-33)
ARDRYYDILTGYYMGFDY

SEQ ID NO: 23501 - protein, 8 aa, Homo sapiens
  Light chain CDR3 for antibody 11751 (IGKV3D-7)
QQDYNLLT

SEQ ID NO: 23502 - protein, 17 aa, Homo sapiens
  Heavy chain CDR3 for antibody 11751 (IGHV3-33)
ARVRGVIEGYYYYGMDV

SEQ ID NO: 23503 - protein, 8 aa, Homo sapiens
  Light chain CDR3 for antibody 11752 (IGKV1D-13)
QQFNNYPT

SEQ ID NO: 23504 - protein, 17 aa, Homo sapiens
  Heavy chain CDR3 for antibody 11752 (IGHV3-33)
ARDQDDILTGYYWYFDL

SEQ ID NO: 23505 - protein, 9 aa, Homo sapiens
  Light chain CDR3 for antibody 11753 (IGKV3-15)
QQYHNWPLT

SEQ ID NO: 23506 - protein, 10 aa, Homo sapiens
  Heavy chain CDR3 for antibody 11753 (IGHV3-33)
AREGLRYFDH

SEQ ID NO: 23507 - protein, 9 aa, Homo sapiens
  Light chain CDR3 for antibody 11754 (IGKV5-2)
LQHDNFPYT

SEQ ID NO: 23508 - protein, 12 aa, Homo sapiens
  Heavy chain CDR3 for antibody 11754 (IGHV3-53)
ARGGFDWGSIDY

SEQ ID NO: 23509 - protein, 9 aa, Homo sapiens
  Light chain CDR3 for antibody 11755 (IGKV6-21)
HQSSSLPYT

SEQ ID NO: 23510 - protein, 14 aa, Homo sapiens
  Heavy chain CDR3 for antibody 11755 (IGHV3-64)
ARDDYVSGSYYFDY

SEQ ID NO: 23511 - protein, 9 aa, Homo sapiens
  Light chain CDR3 for antibody 11756 (IGKV3D-7)
QQDYNLPYT

SEQ ID NO: 23512 - protein, 13 aa, Homo sapiens
  Heavy chain CDR3 for antibody 11756 (IGHV3-21)
ARDSTLVRGVFAY

SEQ ID NO: 23513 - protein, 9 aa, Homo sapiens
  Light chain CDR3 for antibody 11757 (IGKV1-6)
LQDYNYPWT

SEQ ID NO: 23514 - protein, 13 aa, Homo sapiens
  Heavy chain CDR3 for antibody 11757 (IGHV3-33)
AREEVNWGAFFDY

SEQ ID NO: 23515 - protein, 9 aa, Homo sapiens
  Light chain CDR3 for antibody 11758 (IGKV2-30)
MQGTHWPLT

SEQ ID NO: 23516 - protein, 16 aa, Homo sapiens
  Heavy chain CDR3 for antibody 11758 (IGHV3-11)
ARYHYGSGSYYNVGDY

SEQ ID NO: 23517 - protein, 8 aa, Homo sapiens
  Light chain CDR3 for antibody 11759 (IGKV3-11)
LQRGNWPT

SEQ ID NO: 23518 - protein, 16 aa, Homo sapiens
  Heavy chain CDR3 for antibody 11759 (IGHV1-24)
ATDWNDRGYYYYGMDV

SEQ ID NO: 23519 - protein, 9 aa, Homo sapiens
  Light chain CDR3 for antibody 11760 (IGKV1-5)
QQYNTYSRT

SEQ ID NO: 23520 - protein, 12 aa, Homo sapiens
  Heavy chain CDR3 for antibody 11760 (IGHV3-33)
ARDYISTYGMDV

SEQ ID NO: 23521 - protein, 9 aa, Homo sapiens
  Light chain CDR3 for antibody 11761 (IGKV2D-24)
TQATQFPHT

SEQ ID NO: 23522 - protein, 21 aa, Homo sapiens
  Heavy chain CDR3 for antibody 11761 (IGHV1-18)
ASGVLIWFGELLSEDYYDMDV

SEQ ID NO: 23523 - protein, 9 aa, Homo sapiens
  Light chain CDR3 for antibody 11762 (IGKV3D-7)
QQDYEFPIT

SEQ ID NO: 23524 - protein, 17 aa, Homo sapiens
  Heavy chain CDR3 for antibody 11762 (IGHV1-18)
ARDRAFTMVRGVPPFDY

SEQ ID NO: 23525 - protein, 9 aa, Homo sapiens
  Light chain CDR3 for antibody 11763 (IGKV1-17)
QQYGSSPRT

SEQ ID NO: 23526 - protein, 16 aa, Homo sapiens
  Heavy chain CDR3 for antibody 11763 (IGHV3-11)
ARYHYGSGSYYNVGDY

SEQ ID NO: 23527 - protein, 11 aa, Homo sapiens
  Light chain CDR3 for antibody 11764 (IGKV3-11)
QQRSNWPPTWT

SEQ ID NO: 23528 - protein, 14 aa, Homo sapiens
  Heavy chain CDR3 for antibody 11764 (IGHV1-18)
ARCFGSGSYGWFDP

SEQ ID NO: 23529 - protein, 9 aa, Homo sapiens
  Light chain CDR3 for antibody 11765 (IGKV6-21)
QQSSNLPHT

SEQ ID NO: 23530 - protein, 18 aa, Homo sapiens
  Heavy chain CDR3 for antibody 11765 (IGHV4-59)
AREGDYVWGSYRPNWFDP

SEQ ID NO: 23531 - protein, 10 aa, Homo sapiens
  Light chain CDR3 for antibody 11766 (IGKV1-17)
LQHNSYPMYT

SEQ ID NO: 23532 - protein, 15 aa, Homo sapiens
  Heavy chain CDR3 for antibody 11766 (IGHV3-20)
AREGPYYYGSGSLDY

SEQ ID NO: 23533 - protein, 8 aa, Homo sapiens
  Light chain CDR3 for antibody 11767 (IGKV3-20)
QQYGSSLT

SEQ ID NO: 23534 - protein, 15 aa, Homo sapiens
  Heavy chain CDR3 for antibody 11767 (IGHV3-33)
ARHSSGFYYYYGMDV

SEQ ID NO: 23535 - protein, 8 aa, Homo sapiens
  Light chain CDR3 for antibody 11768 (IGKV1D-13)
QQFNNYYT

SEQ ID NO: 23536 - protein, 17 aa, Homo sapiens
  Heavy chain CDR3 for antibody 11768 (IGHV3-23)
AKDYDILTGYSHNWFDP

SEQ ID NO: 23537 - protein, 9 aa, Homo sapiens
  Light chain CDR3 for antibody 11769 (IGKV3-11)
QQRSNWPYT

SEQ ID NO: 23538 - protein, 11 aa, Homo sapiens
  Heavy chain CDR3 for antibody 11769 (IGHV4-59)
AREMGHDIFDI

SEQ ID NO: 23539 - protein, 8 aa, Homo sapiens
  Light chain CDR3 for antibody 11770 (IGKV3D-7)
QQDYNLYT

SEQ ID NO: 23540 - protein, 15 aa, Homo sapiens
  Heavy chain CDR3 for antibody 11770 (IGHV3-33)
AKDRDYDFLSGPFDY

SEQ ID NO: 23541 - protein, 9 aa, Homo sapiens
  Light chain CDR3 for antibody 11771 (IGKV3D-7)
QQDYNLPYT

SEQ ID NO: 23542 - protein, 12 aa, Homo sapiens
  Heavy chain CDR3 for antibody 11771 (IGHV3-23)
AKEGLGNDYESY

SEQ ID NO: 23543 - protein, 9 aa, Homo sapiens
  Light chain CDR3 for antibody 11772 (IGKV1-6)
LQDYKSPFT

SEQ ID NO: 23544 - protein, 13 aa, Homo sapiens
  Heavy chain CDR3 for antibody 11772 (IGHV3-23)
AKDRGGSYSYFDF

SEQ ID NO: 23545 - protein, 10 aa, Homo sapiens
  Light chain CDR3 for antibody 11773 (IGKV1-9)
QQLDSYPMYT

SEQ ID NO: 23546 - protein, 14 aa, Homo sapiens
  Heavy chain CDR3 for antibody 11773 (IGHV3-33)
AREGYSSNWYDLDY

SEQ ID NO: 23547 - protein, 9 aa, Homo sapiens
  Light chain CDR3 for antibody 11774 (IGKV3-11)
QQRSSRPPT

SEQ ID NO: 23548 - protein, 21 aa, Homo sapiens
  Heavy chain CDR3 for antibody 11774 (IGHV3-23)
AKDIDYYGSGSYPLYYYGMDV

SEQ ID NO: 23549 - protein, 8 aa, Homo sapiens
  Light chain CDR3 for antibody 11775 (IGKV3D-7)
QQDYNLLT

SEQ ID NO: 23550 - protein, 14 aa, Homo sapiens
  Heavy chain CDR3 for antibody 11775 (IGHV1-46)
ARDGVGAKEGGFDY

SEQ ID NO: 23551 - protein, 9 aa, Homo sapiens
  Light chain CDR3 for antibody 11776 (IGKV1-9)
QQLKSYLYT

SEQ ID NO: 23552 - protein, 17 aa, Homo sapiens
  Heavy chain CDR3 for antibody 11776 (IGHV3-33)
ARVYYDILTGYSPAFDI

SEQ ID NO: 23553 - protein, 9 aa, Homo sapiens
  Light chain CDR3 for antibody 11777 (IGKV6-21)
HQSSSLPYT

SEQ ID NO: 23554 - protein, 13 aa, Homo sapiens
  Heavy chain CDR3 for antibody 11777 (IGHV4-59)
ARESPGPYDAFDI

SEQ ID NO: 23555 - protein, 10 aa, Homo sapiens
  Light chain CDR3 for antibody 11778 (IGKV3-15)
QQYNNWPPIT

SEQ ID NO: 23556 - protein, 11 aa, Homo sapiens
  Heavy chain CDR3 for antibody 11778 (IGHV4-59)
AREMGHDPFDI

SEQ ID NO: 23557 - protein, 9 aa, Homo sapiens
  Light chain CDR3 for antibody 11779 (IGKV1-39)
QQSYSTPFT

SEQ ID NO: 23558 - protein, 18 aa, Homo sapiens
  Heavy chain CDR3 for antibody 11779 (IGHV1-46)
ARDGDYVWGSYRSDWFDP

SEQ ID NO: 23559 - protein, 9 aa, Homo sapiens
  Light chain CDR3 for antibody 11780 (IGKV1-6)
QQEYNYPLT

SEQ ID NO: 23560 - protein, 8 aa, Homo sapiens
  Heavy chain CDR3 for antibody 11780 (IGHV1-46)
AKETGNNY

SEQ ID NO: 23561 - protein, 9 aa, Homo sapiens
  Light chain CDR3 for antibody 11781 (IGKV3D-20)
QQYGYSPLT

SEQ ID NO: 23562 - protein, 17 aa, Homo sapiens
  Heavy chain CDR3 for antibody 11781 (IGHV4-61)
ARNTMVGTWQRQGNLDH

SEQ ID NO: 23563 - protein, 10 aa, Homo sapiens
  Light chain CDR3 for antibody 11782 (IGKV1-39)
QQSYSTPMYT

SEQ ID NO: 23564 - protein, 8 aa, Homo sapiens
  Heavy chain CDR3 for antibody 11782 (IGHV3-33)
ARDRGFDY

SEQ ID NO: 23565 - protein, 11 aa, Homo sapiens
  Light chain CDR3 for antibody 11783 (IGKV3-11)
QQRSNWPPMYT

SEQ ID NO: 23566 - protein, 13 aa, Homo sapiens
  Heavy chain CDR3 for antibody 11783 (IGHV3-33)
ARTDYYFYYGLDV

SEQ ID NO: 23567 - protein, 9 aa, Homo sapiens
  Light chain CDR3 for antibody 11784 (IGKV2D-28)
MQALQTPPT

SEQ ID NO: 23568 - protein, 17 aa, Homo sapiens
  Heavy chain CDR3 for antibody 11784 (IGHV3-33)
ARESLKLGIYYYYGMDV

SEQ ID NO: 23569 - protein, 9 aa, Homo sapiens
  Light chain CDR3 for antibody 11785 (IGKV1-6)
LQDYKSPFT

SEQ ID NO: 23570 - protein, 17 aa, Homo sapiens
  Heavy chain CDR3 for antibody 11785 (IGHV3-33)
ARGGGYENDHYYYGMDV

SEQ ID NO: 23571 - protein, 9 aa, Homo sapiens
  Light chain CDR3 for antibody 11786 (IGKV1D-16)
QQYYSYPWT

SEQ ID NO: 23572 - protein, 13 aa, Homo sapiens
  Heavy chain CDR3 for antibody 11786 (IGHV3-33)
ARGDNWNDGGFDY

SEQ ID NO: 23573 - protein, 10 aa, Homo sapiens
  Light chain CDR3 for antibody 11787 (IGKV3-11)
QQRSNWPIFP

SEQ ID NO: 23574 - protein, 18 aa, Homo sapiens
  Heavy chain CDR3 for antibody 11787 (IGHV1-8)
ARSSIAAAGIYYYYGMDV

SEQ ID NO: 23575 - protein, 9 aa, Homo sapiens
  Light chain CDR3 for antibody 11788 (IGKV1D-16)
QQYNSYPYT

SEQ ID NO: 23576 - protein, 13 aa, Homo sapiens
  Heavy chain CDR3 for antibody 11788 (IGHV3-30)
AAPFMGRGDGMDV

SEQ ID NO: 23577 - protein, 10 aa, Homo sapiens
  Light chain CDR3 for antibody 11789 (IGKV1-17)
LQHNSYPMYT

SEQ ID NO: 23578 - protein, 8 aa, Homo sapiens
  Heavy chain CDR3 for antibody 11789 (IGHV3-33)
ARDRGFDY

SEQ ID NO: 23579 - protein, 9 aa, Homo sapiens
  Light chain CDR3 for antibody 11790 (IGKV1-17)
LQHYSYPPT

SEQ ID NO: 23580 - protein, 9 aa, Homo sapiens
  Heavy chain CDR3 for antibody 11790 (IGHV3-23)
AKDYGSESP

SEQ ID NO: 23581 - protein, 9 aa, Homo sapiens
  Light chain CDR3 for antibody 11791 (IGKV1-39)
QQSYSTPLT

SEQ ID NO: 23582 - protein, 11 aa, Homo sapiens
  Heavy chain CDR3 for antibody 11791 (IGHV1-18)
SRGGFSVGYDS

SEQ ID NO: 23583 - protein, 9 aa, Homo sapiens
  Light chain CDR3 for antibody 11792 (IGKV1-27)
QKYNSAPYT

SEQ ID NO: 23584 - protein, 14 aa, Homo sapiens
  Heavy chain CDR3 for antibody 11792 (IGHV3-33)
ARDRGRHNYFGMDV

SEQ ID NO: 23585 - protein, 10 aa, Homo sapiens
  Light chain CDR3 for antibody 11793 (IGKV3-11)
QQRSNWPILT

SEQ ID NO: 23586 - protein, 20 aa, Homo sapiens
  Heavy chain CDR3 for antibody 11793 (IGHV3-23)
SRGGATLVRGVIDYYYGMDV

SEQ ID NO: 23587 - protein, 9 aa, Homo sapiens
  Light chain CDR3 for antibody 11794 (IGKV1-9)
QQLYTYPYT

SEQ ID NO: 23588 - protein, 16 aa, Homo sapiens
  Heavy chain CDR3 for antibody 11794 (IGHV3-33)
ARGDDILTHQYYGVDV

SEQ ID NO: 23589 - protein, 9 aa, Homo sapiens
  Light chain CDR3 for antibody 11795 (IGKV2-30)
MQGTHWPYT

SEQ ID NO: 23590 - protein, 14 aa, Homo sapiens
  Heavy chain CDR3 for antibody 11795 (IGHV4-39)
ARQGGSGSYYNLDY

SEQ ID NO: 23591 - protein, 9 aa, Homo sapiens
  Light chain CDR3 for antibody 11796 (IGKV1-6)
LQDFHYPWT

SEQ ID NO: 23592 - protein, 18 aa, Homo sapiens
  Heavy chain CDR3 for antibody 11796 (IGHV3-33)
ARDEYYGSGIYYNYGMDV

SEQ ID NO: 23593 - protein, 9 aa, Homo sapiens
  Light chain CDR3 for antibody 11797 (IGKV1-9)
QQLDNYLFT

SEQ ID NO: 23594 - protein, 9 aa, Homo sapiens
  Heavy chain CDR3 for antibody 11797 (IGHV4-59)
AREGGSGSL

SEQ ID NO: 23595 - protein, 9 aa, Homo sapiens
  Light chain CDR3 for antibody 11798 (IGKV5-2)
LQHDKFPYT

SEQ ID NO: 23596 - protein, 18 aa, Homo sapiens
  Heavy chain CDR3 for antibody 11798 (IGHV3-33)
ARDQGIVVLPGAPWYFDL

SEQ ID NO: 23597 - protein, 10 aa, Homo sapiens
  Light chain CDR3 for antibody 11799 (IGKV3-11)
QQRSNWPIFT

SEQ ID NO: 23598 - protein, 9 aa, Homo sapiens
  Heavy chain CDR3 for antibody 11799 (IGHV4-34)
ARDLYYFDY

SEQ ID NO: 23599 - protein, 9 aa, Homo sapiens
  Light chain CDR3 for antibody 11800 (IGKV1-39)
QQSYSTPIT

SEQ ID NO: 23600 - protein, 22 aa, Homo sapiens
  Heavy chain CDR3 for antibody 11800 (IGHV1-18)
ARDRYNNQSKYRNRDYYYGLDV

SEQ ID NO: 23601 - protein, 10 aa, Homo sapiens
  Light chain CDR3 for antibody 11801 (IGKV3-15)
QQYNNWPPIT

SEQ ID NO: 23602 - protein, 11 aa, Homo sapiens
  Heavy chain CDR3 for antibody 11801 (IGHV3-33)
ARDRATATVDY

SEQ ID NO: 23603 - protein, 10 aa, Homo sapiens
  Light chain CDR3 for antibody 11802 (IGKV3-20)
QQYGRSPPVT

SEQ ID NO: 23604 - protein, 9 aa, Homo sapiens
  Heavy chain CDR3 for antibody 11802 (IGHV3-13)
ARDHWYFDL

SEQ ID NO: 23605 - protein, 10 aa, Homo sapiens
  Light chain CDR3 for antibody 11803 (IGKV3-11)
QQRINWPIFT

SEQ ID NO: 23606 - protein, 16 aa, Homo sapiens
  Heavy chain CDR3 for antibody 11803 (IGHV1-18)
ATEDSSSYYYYYGMDV

SEQ ID NO: 23607 - protein, 9 aa, Homo sapiens
  Light chain CDR3 for antibody 11804 (IGKV2-30)
MQGTHWPLT

SEQ ID NO: 23608 - protein, 13 aa, Homo sapiens
  Heavy chain CDR3 for antibody 11804 (IGHV1-2)
ARDGVRGSFGMDV

SEQ ID NO: 23609 - protein, 9 aa, Homo sapiens
  Light chain CDR3 for antibody 11805 (IGKV1D-16)
QQYSSYQYT

SEQ ID NO: 23610 - protein, 13 aa, Homo sapiens
  Heavy chain CDR3 for antibody 11805 (IGHV3-33)
ARAFTMVRGVIDY

SEQ ID NO: 23611 - protein, 8 aa, Homo sapiens
  Light chain CDR3 for antibody 11806 (IGKV3-20)
QQYGRSFT

SEQ ID NO: 23612 - protein, 15 aa, Homo sapiens
  Heavy chain CDR3 for antibody 11806 (IGHV3-33)
ARDTGYSSSWNWFDP

SEQ ID NO: 23613 - protein, 10 aa, Homo sapiens
  Light chain CDR3 for antibody 11807 (IGKV3-11)
QQRSNWPILT

SEQ ID NO: 23614 - protein, 16 aa, Homo sapiens
  Heavy chain CDR3 for antibody 11807 (IGHV3-23)
ARNDILTASGYYGMDV

SEQ ID NO: 23615 - protein, 9 aa, Homo sapiens
  Light chain CDR3 for antibody 11808 (IGKV1-39)
QQGFSTPWT

SEQ ID NO: 23616 - protein, 11 aa, Homo sapiens
  Heavy chain CDR3 for antibody 11808 (IGHV4-59)
ARDGVRGVFDI

SEQ ID NO: 23617 - protein, 10 aa, Homo sapiens
  Light chain CDR3 for antibody 11809 (IGKV3-11)
QQRSNWPPYT

SEQ ID NO: 23618 - protein, 15 aa, Homo sapiens
  Heavy chain CDR3 for antibody 11809 (IGHV3-64)
ARDGLRYFDWLFPWY

SEQ ID NO: 23619 - protein, 9 aa, Homo sapiens
  Light chain CDR3 for antibody 11810 (IGKV3-15)
QQYNDWPRT

SEQ ID NO: 23620 - protein, 12 aa, Homo sapiens
  Heavy chain CDR3 for antibody 11810 (IGHV3-13)
ARDRGYSGYFDY

SEQ ID NO: 23621 - protein, 9 aa, Homo sapiens
  Light chain CDR3 for antibody 11811 (IGKV3-20)
QQYGSSPYT

SEQ ID NO: 23622 - protein, 17 aa, Homo sapiens
  Heavy chain CDR3 for antibody 11811 (IGHV3-11)
ARAGPRYDSSGHDAFDI

SEQ ID NO: 23623 - protein, 9 aa, Homo sapiens
  Light chain CDR3 for antibody 11812 (IGKV5-2)
LQHDKFPYT

SEQ ID NO: 23624 - protein, 18 aa, Homo sapiens
  Heavy chain CDR3 for antibody 11812 (IGHV3-33)
AREGYYGSGSYYRGWFDP

SEQ ID NO: 23625 - protein, 10 aa, Homo sapiens
  Light chain CDR3 for antibody 11813 (IGKV1-17)
LQHNSYPMYT

SEQ ID NO: 23626 - protein, 10 aa, Homo sapiens
  Heavy chain CDR3 for antibody 11813 (IGHV3-74)
ARENWGGFDY

SEQ ID NO: 23627 - protein, 9 aa, Homo sapiens
  Light chain CDR3 for antibody 11814 (IGKV1-17)
LQYNSYPPT

SEQ ID NO: 23628 - protein, 10 aa, Homo sapiens
  Heavy chain CDR3 for antibody 11814 (IGHV3-23)
AKDRYGDYVY

SEQ ID NO: 23629 - protein, 9 aa, Homo sapiens
  Light chain CDR3 for antibody 11815 (IGKV1-16)
QQYDSYPYT

SEQ ID NO: 23630 - protein, 12 aa, Homo sapiens
  Heavy chain CDR3 for antibody 11815 (IGHV4-59)
ARHPRYLDAFDI

SEQ ID NO: 23631 - protein, 9 aa, Homo sapiens
  Light chain CDR3 for antibody 11816 (IGKV1D-16)
QQYNSYPFT

SEQ ID NO: 23632 - protein, 13 aa, Homo sapiens
  Heavy chain CDR3 for antibody 11816 (IGHV4-59)
ARREVVGGRGFDY

SEQ ID NO: 23633 - protein, 9 aa, Homo sapiens
  Light chain CDR3 for antibody 11817 (IGKV5-2)
LQHDNFPWT

SEQ ID NO: 23634 - protein, 16 aa, Homo sapiens
  Heavy chain CDR3 for antibody 11817 (IGHV3-23)
AKDGIGELSYYYGMDV

SEQ ID NO: 23635 - protein, 10 aa, Homo sapiens
  Light chain CDR3 for antibody 11818 (IGKV1-39)
QQSYSTPMYT

SEQ ID NO: 23636 - protein, 20 aa, Homo sapiens
  Heavy chain CDR3 for antibody 11818 (IGHV3-33)
AKDREMAATSHYYYYYGMDV

SEQ ID NO: 23637 - protein, 10 aa, Homo sapiens
  Light chain CDR3 for antibody 11819 (IGKV3-11)
QQRSNWPALT

SEQ ID NO: 23638 - protein, 14 aa, Homo sapiens
  Heavy chain CDR3 for antibody 11819 (IGHV3-33)
ARDLNYDILNGGGY

SEQ ID NO: 23639 - protein, 9 aa, Homo sapiens
  Light chain CDR3 for antibody 11820 (IGKV1-16)
QHYNDYPFT

SEQ ID NO: 23640 - protein, 14 aa, Homo sapiens
  Heavy chain CDR3 for antibody 11820 (IGHV3-33)
AREGYSSGWDYFDH

SEQ ID NO: 23641 - protein, 10 aa, Homo sapiens
  Light chain CDR3 for antibody 11821 (IGKV3-15)
QQYNNWPPYT

SEQ ID NO: 23642 - protein, 11 aa, Homo sapiens
  Heavy chain CDR3 for antibody 11821 (IGHV3-33)
ARGSGSYAFDY

SEQ ID NO: 23643 - protein, 10 aa, Homo sapiens
  Light chain CDR3 for antibody 11822 (IGKV1-17)
LQHNSYPMYT

SEQ ID NO: 23644 - protein, 16 aa, Homo sapiens
  Heavy chain CDR3 for antibody 11822 (IGHV3-33)
ARAYYYGSGSYPHFQH

SEQ ID NO: 23645 - protein, 8 aa, Homo sapiens
  Light chain CDR3 for antibody 11823 (IGKV3-20)
QQYGSSLT

SEQ ID NO: 23646 - protein, 17 aa, Homo sapiens
  Heavy chain CDR3 for antibody 11823 (IGHV4-34)
ARDGSGSYTHYYYGMDV

SEQ ID NO: 23647 - protein, 9 aa, Homo sapiens
  Light chain CDR3 for antibody 11824 (IGKV3D-7)
QQDYNLPYT

SEQ ID NO: 23648 - protein, 21 aa, Homo sapiens
  Heavy chain CDR3 for antibody 11824 (IGHV3-33)
ARKRLYDILTGYYKAYYGMDV

SEQ ID NO: 23649 - protein, 10 aa, Homo sapiens
  Light chain CDR3 for antibody 11825 (IGKV1-17)
LQHNSYPMYT

SEQ ID NO: 23650 - protein, 17 aa, Homo sapiens
  Heavy chain CDR3 for antibody 11825 (IGHV3-33)
ARGDGDILTGYYEWFDP

SEQ ID NO: 23651 - protein, 8 aa, Homo sapiens
  Light chain CDR3 for antibody 11826 (IGKV3-20)
QQYGSSFT

SEQ ID NO: 23652 - protein, 8 aa, Homo sapiens
  Heavy chain CDR3 for antibody 11826 (IGHV3-23)
AKESLLDY

SEQ ID NO: 23653 - protein, 9 aa, Homo sapiens
  Light chain CDR3 for antibody 11827 (IGKV3-15)
QQYNNWPYT

SEQ ID NO: 23654 - protein, 16 aa, Homo sapiens
  Heavy chain CDR3 for antibody 11827 (IGHV3-13)
ARDRSYESYYYYGMDV

SEQ ID NO: 23655 - protein, 9 aa, Homo sapiens
  Light chain CDR3 for antibody 11828 (IGKV1D-13)
QQFNNYPYT

SEQ ID NO: 23656 - protein, 14 aa, Homo sapiens
  Heavy chain CDR3 for antibody 11828 (IGHV3-20)
ARDRGSSFFDAVDI

SEQ ID NO: 23657 - protein, 9 aa, Homo sapiens
  Light chain CDR3 for antibody 11829 (IGKV6-21)
HQSSSLPQT

SEQ ID NO: 23658 - protein, 16 aa, Homo sapiens
  Heavy chain CDR3 for antibody 11829 (IGHV3-33)
ARGGLTGGGDYDAFDI

SEQ ID NO: 23659 - protein, 8 aa, Homo sapiens
  Light chain CDR3 for antibody 11830 (IGKV1-5)
QQYNSYST

SEQ ID NO: 23660 - protein, 17 aa, Homo sapiens
  Heavy chain CDR3 for antibody 11830 (IGHV1-18)
ARNLHYDILTGYPHFDY

SEQ ID NO: 23661 - protein, 9 aa, Homo sapiens
  Light chain CDR3 for antibody 11831 (IGKV1-33)
QQYDNLPFT

SEQ ID NO: 23662 - protein, 12 aa, Homo sapiens
  Heavy chain CDR3 for antibody 11831 (IGHV4-61)
ARVYSSGWIFDY

SEQ ID NO: 23663 - protein, 10 aa, Homo sapiens
  Light chain CDR3 for antibody 11832 (IGKV3-20)
QQYGRSPPVT

SEQ ID NO: 23664 - protein, 15 aa, Homo sapiens
  Heavy chain CDR3 for antibody 11832 (IGHV3-33)
ARDEHYDILTGYWDY

SEQ ID NO: 23665 - protein, 9 aa, Homo sapiens
  Light chain CDR3 for antibody 11833 (IGKV6-21)
HQSSNLPYT

SEQ ID NO: 23666 - protein, 16 aa, Homo sapiens
  Heavy chain CDR3 for antibody 11833 (IGHV1-8)
AREGTMVRGVDYGMDV

SEQ ID NO: 23667 - protein, 9 aa, Homo sapiens
  Light chain CDR3 for antibody 11834 (IGKV6-21)
HQSSSLPHT

SEQ ID NO: 23668 - protein, 18 aa, Homo sapiens
  Heavy chain CDR3 for antibody 11834 (IGHV3-23)
AKEGDYYGSGSYWGYFDP

SEQ ID NO: 23669 - protein, 9 aa, Homo sapiens
  Light chain CDR3 for antibody 11835 (IGKV5-2)
LQHDNFPYT

SEQ ID NO: 23670 - protein, 8 aa, Homo sapiens
  Heavy chain CDR3 for antibody 11835 (IGHV3-33)
ARDDPPRY

SEQ ID NO: 23671 - protein, 9 aa, Homo sapiens
  Light chain CDR3 for antibody 11836 (IGKV1-6)
LQDYKSPFT

SEQ ID NO: 23672 - protein, 12 aa, Homo sapiens
  Heavy chain CDR3 for antibody 11836 (IGHV4-59)
ARDRSGWAYFDY

SEQ ID NO: 23673 - protein, 9 aa, Homo sapiens
  Light chain CDR3 for antibody 11837 (IGKV3-11)
QQRSNWMYT

SEQ ID NO: 23674 - protein, 16 aa, Homo sapiens
  Heavy chain CDR3 for antibody 11837 (IGHV4-59)
ARRRYFEWLLGDVFDI

SEQ ID NO: 23675 - protein, 9 aa, Homo sapiens
  Light chain CDR3 for antibody 11838 (IGKV1-39)
QQGYSTPWT

SEQ ID NO: 23676 - protein, 18 aa, Homo sapiens
  Heavy chain CDR3 for antibody 11838 (IGHV3-23)
ARYHLYFGSGFGSDGMDV

SEQ ID NO: 23677 - protein, 9 aa, Homo sapiens
  Light chain CDR3 for antibody 11839 (IGKV2D-24)
MQATQFPHT

SEQ ID NO: 23678 - protein, 15 aa, Homo sapiens
  Heavy chain CDR3 for antibody 11839 (IGHV3-30)
ARRGYGSGSPDAFDL

SEQ ID NO: 23679 - protein, 9 aa, Homo sapiens
  Light chain CDR3 for antibody 11840 (IGKV1-6)
LQDYNYPFT

SEQ ID NO: 23680 - protein, 15 aa, Homo sapiens
  Heavy chain CDR3 for antibody 11840 (IGHV3-33)
ARSVCSGGSCALLDY

SEQ ID NO: 23681 - protein, 9 aa, Homo sapiens
  Light chain CDR3 for antibody 11841 (IGKV1D-16)
QQYNRYPYT

SEQ ID NO: 23682 - protein, 12 aa, Homo sapiens
  Heavy chain CDR3 for antibody 11841 (IGHV4-39)
ARREVILGAFDY

SEQ ID NO: 23683 - protein, 9 aa, Homo sapiens
  Light chain CDR3 for antibody 11842 (IGKV6-21)
HQSSSLPYT

SEQ ID NO: 23684 - protein, 19 aa, Homo sapiens
  Heavy chain CDR3 for antibody 11842 (IGHV3-33)
ARGSDYDILTGYSSDAFDI

SEQ ID NO: 23685 - protein, 9 aa, Homo sapiens
  Light chain CDR3 for antibody 11843 (IGKV2D-28)
MQALQTPFT

SEQ ID NO: 23686 - protein, 20 aa, Homo sapiens
  Heavy chain CDR3 for antibody 11843 (IGHV4-b)
AKPRSPVSRRYLYYHYGMDV

SEQ ID NO: 23687 - protein, 11 aa, Homo sapiens
  Light chain CDR3 for antibody 11844 (IGKV3-11)
QQRSNWPPTWT

SEQ ID NO: 23688 - protein, 8 aa, Homo sapiens
  Heavy chain CDR3 for antibody 11844 (IGHV3-23)
AKESLLDY

SEQ ID NO: 23689 - protein, 9 aa, Homo sapiens
  Light chain CDR3 for antibody 11845 (IGKV3D-7)
QQDYNLPYS

SEQ ID NO: 23690 - protein, 12 aa, Homo sapiens
  Heavy chain CDR3 for antibody 11845 (IGHV3-33)
ARDPGYYYGLEV

SEQ ID NO: 23691 - protein, 8 aa, Homo sapiens
  Light chain CDR3 for antibody 11846 (IGKV1D-13)
QQFNNYPT

SEQ ID NO: 23692 - protein, 13 aa, Homo sapiens
  Heavy chain CDR3 for antibody 11846 (IGHV3-23)
AKDRGLRYYGMDV

SEQ ID NO: 23693 - protein, 9 aa, Homo sapiens
  Light chain CDR3 for antibody 11847 (IGKV1-6)
LQDYNYPRT

SEQ ID NO: 23694 - protein, 13 aa, Homo sapiens
  Heavy chain CDR3 for antibody 11847 (IGHV3-33)
ARAYYDILTGYSL

SEQ ID NO: 23695 - protein, 10 aa, Homo sapiens
  Light chain CDR3 for antibody 11848 (IGKV1-17)
LQHNSYPMYT

SEQ ID NO: 23696 - protein, 13 aa, Homo sapiens
  Heavy chain CDR3 for antibody 11848 (IGHV4-39)
ARHVLLWFGEFDP

SEQ ID NO: 23697 - protein, 9 aa, Homo sapiens
  Light chain CDR3 for antibody 11849 (IGKV6-21)
HQSSSLPYT

SEQ ID NO: 23698 - protein, 13 aa, Homo sapiens
  Heavy chain CDR3 for antibody 11849 (IGHV3-53)
ARDRDSSGSYCDY

SEQ ID NO: 23699 - protein, 9 aa, Homo sapiens
  Light chain CDR3 for antibody 11850 (IGKV1-39)
QQSYSTPYT

SEQ ID NO: 23700 - protein, 15 aa, Homo sapiens
  Heavy chain CDR3 for antibody 11850 (IGHV3-33)
ARDRGSSGYDRYFDY

SEQ ID NO: 23701 - protein, 9 aa, Homo sapiens
  Light chain CDR3 for antibody 11851 (IGKV1-16)
QHYNDYPFT

SEQ ID NO: 23702 - protein, 14 aa, Homo sapiens
  Heavy chain CDR3 for antibody 11851 (IGHV3-33)
ARDAYDILTGYYDY

SEQ ID NO: 23703 - protein, 8 aa, Homo sapiens
  Light chain CDR3 for antibody 11852 (IGKV1-5)
QQYNSYYT

SEQ ID NO: 23704 - protein, 18 aa, Homo sapiens
  Heavy chain CDR3 for antibody 11852 (IGHV4-39)
ARQYYFGSGNYYRGWFDH

SEQ ID NO: 23705 - protein, 9 aa, Homo sapiens
  Light chain CDR3 for antibody 11853 (IGKV6-21)
HQSSSLPLT

SEQ ID NO: 23706 - protein, 17 aa, Homo sapiens
  Heavy chain CDR3 for antibody 11853 (IGHV3-33)
ARSMVTTYGYYYYGMDV

SEQ ID NO: 23707 - protein, 9 aa, Homo sapiens
  Light chain CDR3 for antibody 11854 (IGKV1-9)
QQLISYPYT

SEQ ID NO: 23708 - protein, 11 aa, Homo sapiens
  Heavy chain CDR3 for antibody 11854 (IGHV3-11)
ARASRGSYYDY

SEQ ID NO: 23709 - protein, 9 aa, Homo sapiens
  Light chain CDR3 for antibody 11855 (IGKV3-15)
QQYSNWPLT

SEQ ID NO: 23710 - protein, 10 aa, Homo sapiens
  Heavy chain CDR3 for antibody 11855 (IGHV1-8)
AKDRYGDYVY

SEQ ID NO: 23711 - protein, 10 aa, Homo sapiens
  Light chain CDR3 for antibody 11856 (IGKV3-11)
QQRSNWPAYT

SEQ ID NO: 23712 - protein, 19 aa, Homo sapiens
  Heavy chain CDR3 for antibody 11856 (IGHV4-59)
ARDRVVGATTYYYYYGMDV

SEQ ID NO: 23713 - protein, 9 aa, Homo sapiens
  Light chain CDR3 for antibody 11857 (IGKV3D-20)
QQFGSLPLT

SEQ ID NO: 23714 - protein, 12 aa, Homo sapiens
  Heavy chain CDR3 for antibody 11857 (IGHV4-39)
ARQMVREGWFDP

SEQ ID NO: 23715 - protein, 9 aa, Homo sapiens
  Light chain CDR3 for antibody 11858 (IGKV1-5)
QQYNTYSRT

SEQ ID NO: 23716 - protein, 18 aa, Homo sapiens
  Heavy chain CDR3 for antibody 11858 (IGHV3-33)
ARGLLWFGVSYYYYGMDV

SEQ ID NO: 23717 - protein, 11 aa, Homo sapiens
  Light chain CDR3 for antibody 11859 (IGKV3-11)
QQRSNWPPTWT

SEQ ID NO: 23718 - protein, 15 aa, Homo sapiens
  Heavy chain CDR3 for antibody 11859 (IGHV1-46)
ARGRFFDWLLSPFDY

SEQ ID NO: 23719 - protein, 9 aa, Homo sapiens
  Light chain CDR3 for antibody 11860 (IGKV3-11)
QQRSNWPLT

SEQ ID NO: 23720 - protein, 22 aa, Homo sapiens
  Heavy chain CDR3 for antibody 11860 (IGHV3-33)
AREAYYDILTGYYTGYYYGMDV

SEQ ID NO: 23721 - protein, 9 aa, Homo sapiens
  Light chain CDR3 for antibody 11861 (IGKV1-39)
QQSYSTPYT

SEQ ID NO: 23722 - protein, 11 aa, Homo sapiens
  Heavy chain CDR3 for antibody 11861 (IGHV3-30)
ARERDIGDFDY

SEQ ID NO: 23723 - protein, 9 aa, Homo sapiens
  Light chain CDR3 for antibody 11862 (IGKV1-9)
QQYNSYPYT

SEQ ID NO: 23724 - protein, 15 aa, Homo sapiens
  Heavy chain CDR3 for antibody 11862 (IGHV3-30)
ARGAMVRGGDYCMDV

SEQ ID NO: 23725 - protein, 9 aa, Homo sapiens
  Light chain CDR3 for antibody 11863 (IGKV1-6)
QQFNNYPYT

SEQ ID NO: 23726 - protein, 9 aa, Homo sapiens
  Heavy chain CDR3 for antibody 11863 (IGHV3-30)
ARGRVSLDV

SEQ ID NO: 23727 - protein, 9 aa, Homo sapiens
  Light chain CDR3 for antibody 11864 (IGKV1D-13)
QRFNNYLYT

SEQ ID NO: 23728 - protein, 11 aa, Homo sapiens
  Heavy chain CDR3 for antibody 11864 (IGHV3-33)
ARAGIAALFDY

SEQ ID NO: 23729 - protein, 9 aa, Homo sapiens
  Light chain CDR3 for antibody 11865 (IGKV1-17)
LQHNSYPYT

SEQ ID NO: 23730 - protein, 16 aa, Homo sapiens
  Heavy chain CDR3 for antibody 11865 (IGHV3-33)
ARGFSGYDGYYYGMDV

SEQ ID NO: 23731 - protein, 9 aa, Homo sapiens
  Light chain CDR3 for antibody 11866 (IGKV1-9)
QQLNNYLFT

SEQ ID NO: 23732 - protein, 26 aa, Homo sapiens
  Heavy chain CDR3 for antibody 11866 (IGHV4-39)
ARQGLLWFGDLKAYDSSGYYYGYFHH

SEQ ID NO: 23733 - protein, 9 aa, Homo sapiens
  Light chain CDR3 for antibody 11867 (IGKV3-11)
QQRSNSPLT

SEQ ID NO: 23734 - protein, 16 aa, Homo sapiens
  Heavy chain CDR3 for antibody 11867 (IGHV4-59)
ARYSGSYYGDYYGMDV

SEQ ID NO: 23735 - protein, 9 aa, Homo sapiens
  Light chain CDR3 for antibody 11868 (IGKV1-6)
QQEYNYPLT

SEQ ID NO: 23736 - protein, 18 aa, Homo sapiens
  Heavy chain CDR3 for antibody 11868 (IGHV3-33)
ARGLLWFGVSYYYYGMDV

SEQ ID NO: 23737 - protein, 8 aa, Homo sapiens
  Light chain CDR3 for antibody 11869 (IGKV3-11)
QQRSNWLT

SEQ ID NO: 23738 - protein, 13 aa, Homo sapiens
  Heavy chain CDR3 for antibody 11869 (IGHV3-33)
ARKAYGDYFYFDY

SEQ ID NO: 23739 - protein, 8 aa, Homo sapiens
  Light chain CDR3 for antibody 11870 (IGKV3D-7)
QQDYNLLT

SEQ ID NO: 23740 - protein, 18 aa, Homo sapiens
  Heavy chain CDR3 for antibody 11870 (IGHV3-33)
VRERGHYGSGSFPDAFDI

SEQ ID NO: 23741 - protein, 9 aa, Homo sapiens
  Light chain CDR3 for antibody 11871 (IGKV1-39)
QQSYSTPYT

SEQ ID NO: 23742 - protein, 19 aa, Homo sapiens
  Heavy chain CDR3 for antibody 11871 (IGHV3-33)
ARDSSYYDILTGSPYGMDV

SEQ ID NO: 23743 - protein, 9 aa, Homo sapiens
  Light chain CDR3 for antibody 11872 (IGKV3D-7)
QQDYEFPIT

SEQ ID NO: 23744 - protein, 19 aa, Homo sapiens
  Heavy chain CDR3 for antibody 11872 (IGHV3-33)
TRDPHYDILTGYAYYGMDV

SEQ ID NO: 23745 - protein, 10 aa, Homo sapiens
  Light chain CDR3 for antibody 11873 (IGKV3-20)
QQYGRSPPVT

SEQ ID NO: 23746 - protein, 17 aa, Homo sapiens
  Heavy chain CDR3 for antibody 11873 (IGHV3-33)
ARAYYDILTGYSYYFDY

SEQ ID NO: 23747 - protein, 9 aa, Homo sapiens
  Light chain CDR3 for antibody 11874 (IGKV3-20)
QQYGRSPYT

SEQ ID NO: 23748 - protein, 16 aa, Homo sapiens
  Heavy chain CDR3 for antibody 11874 (IGHV3-33)
ARGGRSDWLYYYGMDV

SEQ ID NO: 23749 - protein, 8 aa, Homo sapiens
  Light chain CDR3 for antibody 11875 (IGKV3-20)
QQYGRSFT

SEQ ID NO: 23750 - protein, 13 aa, Homo sapiens
  Heavy chain CDR3 for antibody 11875 (IGHV4-59)
ANRDYYGYYGMDV

SEQ ID NO: 23751 - protein, 9 aa, Homo sapiens
  Light chain CDR3 for antibody 11876 (IGKV3D-7)
QQDYTLPRT

SEQ ID NO: 23752 - protein, 12 aa, Homo sapiens
  Heavy chain CDR3 for antibody 11876 (IGHV3-23)
AKEGLGSDYESY

SEQ ID NO: 23753 - protein, 9 aa, Homo sapiens
  Light chain CDR3 for antibody 11877 (IGKV1-5)
QQYNTYSRT

SEQ ID NO: 23754 - protein, 12 aa, Homo sapiens
  Heavy chain CDR3 for antibody 11877 (IGHV3-20)
ARDPGYYYGLDV

SEQ ID NO: 23755 - protein, 8 aa, Homo sapiens
  Light chain CDR3 for antibody 11878 (IGKV6-21)
HQSSSLPT

SEQ ID NO: 23756 - protein, 11 aa, Homo sapiens
  Heavy chain CDR3 for antibody 11878 (IGHV3-33)
ARDILTGFLDH

SEQ ID NO: 23757 - protein, 9 aa, Homo sapiens
  Light chain CDR3 for antibody 11879 (IGKV1-39)
QQSYSTPLT

SEQ ID NO: 23758 - protein, 17 aa, Homo sapiens
  Heavy chain CDR3 for antibody 11879 (IGHV3-23)
AKGDYYGSGSYSTFFDY

SEQ ID NO: 23759 - protein, 9 aa, Homo sapiens
  Light chain CDR3 for antibody 11880 (IGKV1-17)
LQHNSYPLT

SEQ ID NO: 23760 - protein, 15 aa, Homo sapiens
  Heavy chain CDR3 for antibody 11880 (IGHV1-18)
ARIYYGSGSSYYFDY

SEQ ID NO: 23761 - protein, 9 aa, Homo sapiens
  Light chain CDR3 for antibody 11881 (IGKV1D-16)
QQYNSYPRT

SEQ ID NO: 23762 - protein, 11 aa, Homo sapiens
  Heavy chain CDR3 for antibody 11881 (IGHV3-33)
ARDRATAGLDY

SEQ ID NO: 23763 - protein, 9 aa, Homo sapiens
  Light chain CDR3 for antibody 11882 (IGKV1-6)
LQDFHYPWT

SEQ ID NO: 23764 - protein, 15 aa, Homo sapiens
  Heavy chain CDR3 for antibody 11882 (IGHV3-33)
ARRICSGGSCSLFDY

SEQ ID NO: 23765 - protein, 9 aa, Homo sapiens
  Light chain CDR3 for antibody 11883 (IGKV3D-20)
QQYGRSPRT

SEQ ID NO: 23766 - protein, 9 aa, Homo sapiens
  Heavy chain CDR3 for antibody 11883 (IGHV3-30)
ARDDWGFDY

SEQ ID NO: 23767 - protein, 9 aa, Homo sapiens
  Light chain CDR3 for antibody 11884 (IGKV5-2)
LQHDKFPYT

SEQ ID NO: 23768 - protein, 10 aa, Homo sapiens
  Heavy chain CDR3 for antibody 11884 (IGHV3-13)
ARDRGSYYDY

SEQ ID NO: 23769 - protein, 8 aa, Homo sapiens
  Light chain CDR3 for antibody 11885 (IGKV3-11)
QQRSNWLT

SEQ ID NO: 23770 - protein, 15 aa, Homo sapiens
  Heavy chain CDR3 for antibody 11885 (IGHV3-23)
AKDGSYYDYYYGMDV

SEQ ID NO: 23771 - protein, 9 aa, Homo sapiens
  Light chain CDR3 for antibody 11886 (IGKV1D-16)
QQLKSYPYT

SEQ ID NO: 23772 - protein, 13 aa, Homo sapiens
  Heavy chain CDR3 for antibody 11886 (IGHV3-33)
ASAGNSYYNVMDV

SEQ ID NO: 23773 - protein, 9 aa, Homo sapiens
  Light chain CDR3 for antibody 11887 (IGKV3-11)
QQYSNWPLT

SEQ ID NO: 23774 - protein, 9 aa, Homo sapiens
  Heavy chain CDR3 for antibody 11887 (IGHV3-30)
ARDDYGVDV

SEQ ID NO: 23775 - protein, 10 aa, Homo sapiens
  Light chain CDR3 for antibody 11888 (IGKV3-20)
QQYGRSPPVT

SEQ ID NO: 23776 - protein, 8 aa, Homo sapiens
  Heavy chain CDR3 for antibody 11888 (IGHV3-23)
AETFLFDY

SEQ ID NO: 23777 - protein, 9 aa, Homo sapiens
  Light chain CDR3 for antibody 11889 (IGKV1-9)
QQLISYPLT

SEQ ID NO: 23778 - protein, 13 aa, Homo sapiens
  Heavy chain CDR3 for antibody 11889 (IGHV3-33)
ARVDYYNYYGLDV

SEQ ID NO: 23779 - protein, 9 aa, Homo sapiens
  Light chain CDR3 for antibody 11890 (IGKV1-27)
QQYNSAPYT

SEQ ID NO: 23780 - protein, 19 aa, Homo sapiens
  Heavy chain CDR3 for antibody 11890 (IGHV3-33)
ARGGVVRGVIEYYYYGMDV

SEQ ID NO: 23781 - protein, 9 aa, Homo sapiens
  Light chain CDR3 for antibody 11891 (IGKV3D-7)
QQDYEFPLT

SEQ ID NO: 23782 - protein, 13 aa, Homo sapiens
  Heavy chain CDR3 for antibody 11891 (IGHV4-59)
ARDEGYRGYVLDT

SEQ ID NO: 23783 - protein, 10 aa, Homo sapiens
  Light chain CDR3 for antibody 11892 (IGKV3-11)
QQRSNWPIFT

SEQ ID NO: 23784 - protein, 12 aa, Homo sapiens
  Heavy chain CDR3 for antibody 11892 (IGHV3-13)
AIGTMVRGIPDY

SEQ ID NO: 23785 - protein, 9 aa, Homo sapiens
  Light chain CDR3 for antibody 11893 (IGKV1-17)
LQHNSYPRT

SEQ ID NO: 23786 - protein, 15 aa, Homo sapiens
  Heavy chain CDR3 for antibody 11893 (IGHV3-64)
ARDSHHDLLTGHYEY

SEQ ID NO: 23787 - protein, 11 aa, Homo sapiens
  Light chain CDR3 for antibody 11894 (IGKV3-11)
QQRSNWPPTWT

SEQ ID NO: 23788 - protein, 13 aa, Homo sapiens
  Heavy chain CDR3 for antibody 11894 (IGHV4-39)
ARPGIVAAGWFDP

SEQ ID NO: 23789 - protein, 8 aa, Homo sapiens
  Light chain CDR3 for antibody 11895 (IGKV1D-13)
QQFNNYYT

SEQ ID NO: 23790 - protein, 13 aa, Homo sapiens
  Heavy chain CDR3 for antibody 11895 (IGHV4-59)
ARTMVRGVAPFDY

SEQ ID NO: 23791 - protein, 8 aa, Homo sapiens
  Light chain CDR3 for antibody 11896 (IGKV1-6)
LQDYNYYT

SEQ ID NO: 23792 - protein, 14 aa, Homo sapiens
  Heavy chain CDR3 for antibody 11896 (IGHV3-23)
AKSRIVGALYYFDY

SEQ ID NO: 23793 - protein, 9 aa, Homo sapiens
  Light chain CDR3 for antibody 11897 (IGKV3-15)
QQYNNWPYT

SEQ ID NO: 23794 - protein, 10 aa, Homo sapiens
  Heavy chain CDR3 for antibody 11897 (IGHV3-23)
AKDHWGDFDY

SEQ ID NO: 23795 - protein, 9 aa, Homo sapiens
  Light chain CDR3 for antibody 11898 (IGKV1D-13)
QQFNNYPYT

SEQ ID NO: 23796 - protein, 17 aa, Homo sapiens
  Heavy chain CDR3 for antibody 11898 (IGHV3-33)
AREGAMVRGYYYYGMDV

SEQ ID NO: 23797 - protein, 9 aa, Homo sapiens
  Light chain CDR3 for antibody 11899 (IGKV1-9)
QQLNGYPFT

SEQ ID NO: 23798 - protein, 23 aa, Homo sapiens
  Heavy chain CDR3 for antibody 11899 (IGHV4-59)
ARERTYSDILPGYYEDYYYGMDV

SEQ ID NO: 23799 - protein, 9 aa, Homo sapiens
  Light chain CDR3 for antibody 11900 (IGKV1-9)
QQYYTYPYT

SEQ ID NO: 23800 - protein, 14 aa, Homo sapiens
  Heavy chain CDR3 for antibody 11900 (IGHV3-33)
AREDYYGPLNWFDP

SEQ ID NO: 23801 - protein, 10 aa, Homo sapiens
  Light chain CDR3 for antibody 11901 (IGKV1-17)
LQHNSYPMYT

SEQ ID NO: 23802 - protein, 11 aa, Homo sapiens
  Heavy chain CDR3 for antibody 11901 (IGHV1-24)
ATELGLYYFDY

SEQ ID NO: 23803 - protein, 8 aa, Homo sapiens
  Light chain CDR3 for antibody 11902 (IGKV2D-28)
MQALQTPT

SEQ ID NO: 23804 - protein, 16 aa, Homo sapiens
  Heavy chain CDR3 for antibody 11902 (IGHV1-24)
ATEDSSSTYYYYGLDV

SEQ ID NO: 23805 - protein, 10 aa, Homo sapiens
  Light chain CDR3 for antibody 11903 (IGKV1-17)
LQHNSYPMYT

SEQ ID NO: 23806 - protein, 11 aa, Homo sapiens
  Heavy chain CDR3 for antibody 11903 (IGHV3-33)
ARGTTVTHFDY

SEQ ID NO: 23807 - protein, 9 aa, Homo sapiens
  Light chain CDR3 for antibody 11904 (IGKV1D-13)
QQFNNYPHT

SEQ ID NO: 23808 - protein, 19 aa, Homo sapiens
  Heavy chain CDR3 for antibody 11904 (IGHV4-39)
ARQGDVLRYFDWLLGAFDI

SEQ ID NO: 23809 - protein, 9 aa, Homo sapiens
  Light chain CDR3 for antibody 11905 (IGKV1D-13)
QHFNNYMYT

SEQ ID NO: 23810 - protein, 19 aa, Homo sapiens
  Heavy chain CDR3 for antibody 11905 (IGHV5-51)
ARHGEKGKRITMVRGSLDV

SEQ ID NO: 23811 - protein, 9 aa, Homo sapiens
  Light chain CDR3 for antibody 11906 (IGKV3-20)
QQYGSSPYT

SEQ ID NO: 23812 - protein, 14 aa, Homo sapiens
  Heavy chain CDR3 for antibody 11906 (IGHV3-20)
ARDGGSGSYDGLDV

SEQ ID NO: 23813 - protein, 9 aa, Homo sapiens
  Light chain CDR3 for antibody 11907 (IGKV1D-16)
QQYNSYPYT

SEQ ID NO: 23814 - protein, 15 aa, Homo sapiens
  Heavy chain CDR3 for antibody 11907 (IGHV4-39)
ARRVRGLIITRYFDY

SEQ ID NO: 23815 - protein, 11 aa, Homo sapiens
  Light chain CDR3 for antibody 11908 (IGKV3-11)
QQRSNWPPTWT

SEQ ID NO: 23816 - protein, 11 aa, Homo sapiens
  Heavy chain CDR3 for antibody 11908 (IGHV3-33)
ARDTWDDYFDY

SEQ ID NO: 23817 - protein, 9 aa, Homo sapiens
  Light chain CDR3 for antibody 11909 (IGKV1D-13)
QQFNNYPYT

SEQ ID NO: 23818 - protein, 12 aa, Homo sapiens
  Heavy chain CDR3 for antibody 11909 (IGHV4-59)
ARVGRFGEFFDY

SEQ ID NO: 23819 - protein, 10 aa, Homo sapiens
  Light chain CDR3 for antibody 11910 (IGKV1-39)
QQSYSTPMYT

SEQ ID NO: 23820 - protein, 17 aa, Homo sapiens
  Heavy chain CDR3 for antibody 11910 (IGHV4-34)
ARDGSGSYTHYYYGMDV

SEQ ID NO: 23821 - protein, 9 aa, Homo sapiens
  Light chain CDR3 for antibody 11911 (IGKV3-11)
QQRSNWPPT

SEQ ID NO: 23822 - protein, 15 aa, Homo sapiens
  Heavy chain CDR3 for antibody 11911 (IGHV3-33)
ARGYYYGSGSYPLDY

SEQ ID NO: 23823 - protein, 9 aa, Homo sapiens
  Light chain CDR3 for antibody 11912 (IGKV5-2)
LQRDKFPYT

SEQ ID NO: 23824 - protein, 11 aa, Homo sapiens
  Heavy chain CDR3 for antibody 11912 (IGHV3-33)
ARDRGNWGFDY

SEQ ID NO: 23825 - protein, 9 aa, Homo sapiens
  Light chain CDR3 for antibody 11913 (IGKV1-6)
LQDFHYPWT

SEQ ID NO: 23826 - protein, 14 aa, Homo sapiens
  Heavy chain CDR3 for antibody 11913 (IGHV3-33)
ARDREQQLVRYFDY

SEQ ID NO: 23827 - protein, 9 aa, Homo sapiens
  Light chain CDR3 for antibody 11914 (IGKV1-9)
QQLISYPLT

SEQ ID NO: 23828 - protein, 18 aa, Homo sapiens
  Heavy chain CDR3 for antibody 11914 (IGHV3-33)
ARKRLYDILTGYPYYFDY

SEQ ID NO: 23829 - protein, 9 aa, Homo sapiens
  Light chain CDR3 for antibody 11915 (IGKV1D-16)
QQYNSYPFT

SEQ ID NO: 23830 - protein, 17 aa, Homo sapiens
  Heavy chain CDR3 for antibody 11915 (IGHV4-59)
ARDFLVRGEGSYYGMEV

SEQ ID NO: 23831 - protein, 9 aa, Homo sapiens
  Light chain CDR3 for antibody 11916 (IGKV1-9)
QQLISYPLT

SEQ ID NO: 23832 - protein, 18 aa, Homo sapiens
  Heavy chain CDR3 for antibody 11916 (IGHV3-33)
ARKRLYDILTGYSDAFEI

SEQ ID NO: 23833 - protein, 9 aa, Homo sapiens
  Light chain CDR3 for antibody 11917 (IGKV6-21)
HQSSNLPYT

SEQ ID NO: 23834 - protein, 15 aa, Homo sapiens
  Heavy chain CDR3 for antibody 11917 (IGHV1-8)
AREGTMVRGVPPFDY

SEQ ID NO: 23835 - protein, 8 aa, Homo sapiens
  Light chain CDR3 for antibody 11918 (IGKV3-11)
QQRSNWLT

SEQ ID NO: 23836 - protein, 12 aa, Homo sapiens
  Heavy chain CDR3 for antibody 11918 (IGHV3-33)
AREGDILTSYSL

SEQ ID NO: 23837 - protein, 10 aa, Homo sapiens
  Light chain CDR3 for antibody 11919 (IGKV1-39)
QQSYSTPMYT

SEQ ID NO: 23838 - protein, 15 aa, Homo sapiens
  Heavy chain CDR3 for antibody 11919 (IGHV3-33)
ARDRMVRGVMGYFDY

SEQ ID NO: 23839 - protein, 9 aa, Homo sapiens
  Light chain CDR3 for antibody 11920 (IGKV3-15)
QQYSNWPFT

SEQ ID NO: 23840 - protein, 18 aa, Homo sapiens
  Heavy chain CDR3 for antibody 11920 (IGHV1-18)
ARDPNYYGSGSYYNYFGY

SEQ ID NO: 23841 - protein, 9 aa, Homo sapiens
  Light chain CDR3 for antibody 11921 (IGKV1-39)
QQSYRTPLT

SEQ ID NO: 23842 - protein, 6 aa, Homo sapiens
  Heavy chain CDR3 for antibody 11921 (IGHV3-23)
AKYIDY

SEQ ID NO: 23843 - protein, 9 aa, Homo sapiens
  Light chain CDR3 for antibody 11922 (IGKV2-30)
MQGTHWPYT

SEQ ID NO: 23844 - protein, 12 aa, Homo sapiens
  Heavy chain CDR3 for antibody 11922 (IGHV3-33)
ARKGYGLYVLDV

SEQ ID NO: 23845 - protein, 9 aa, Homo sapiens
  Light chain CDR3 for antibody 11923 (IGKV3D-7)
QQDYTLPLT

SEQ ID NO: 23846 - protein, 16 aa, Homo sapiens
  Heavy chain CDR3 for antibody 11923 (IGHV3-20)
AREGYSSSWFDRNFDY

SEQ ID NO: 23847 - protein, 9 aa, Homo sapiens
  Light chain CDR3 for antibody 11924 (IGKV1-9)
QQLNTYPWT

SEQ ID NO: 23848 - protein, 17 aa, Homo sapiens
  Heavy chain CDR3 for antibody 11924 (IGHV4-39)
ARVLRYFDWLSHDAFDI

SEQ ID NO: 23849 - protein, 8 aa, Homo sapiens
  Light chain CDR3 for antibody 11925 (IGKV3-11)
QQRSNWLT

SEQ ID NO: 23850 - protein, 13 aa, Homo sapiens
  Heavy chain CDR3 for antibody 11925 (IGHV4-39)
ARRDVLAPAAFDY

SEQ ID NO: 23851 - protein, 9 aa, Homo sapiens
  Light chain CDR3 for antibody 11926 (IGKV1-9)
QQLKSYLYT

SEQ ID NO: 23852 - protein, 13 aa, Homo sapiens
  Heavy chain CDR3 for antibody 11926 (IGHV1-18)
AREYCSGGSCYDY

SEQ ID NO: 23853 - protein, 9 aa, Homo sapiens
  Light chain CDR3 for antibody 11927 (IGKV1-16)
QKYNSNPLT

SEQ ID NO: 23854 - protein, 11 aa, Homo sapiens
  Heavy chain CDR3 for antibody 11927 (IGHV3-33)
ARDRVLTPFDY

SEQ ID NO: 23855 - protein, 9 aa, Homo sapiens
  Light chain CDR3 for antibody 11928 (IGKV1-17)
LHSNNYPWT

SEQ ID NO: 23856 - protein, 14 aa, Homo sapiens
  Heavy chain CDR3 for antibody 11928 (IGHV3-33)
ARGAAAGNFYGLDV

SEQ ID NO: 23857 - protein, 8 aa, Homo sapiens
  Light chain CDR3 for antibody 11929 (IGKV3D-7)
QQDYSLLT

SEQ ID NO: 23858 - protein, 19 aa, Homo sapiens
  Heavy chain CDR3 for antibody 11929 (IGHV3-33)
AKDGRSGSYDYYYYYGMDV

SEQ ID NO: 23859 - protein, 9 aa, Homo sapiens
  Light chain CDR3 for antibody 11930 (IGKV1-9)
QQLKSYPYT

SEQ ID NO: 23860 - protein, 13 aa, Homo sapiens
  Heavy chain CDR3 for antibody 11930 (IGHV3-30)
AAPFMVRGDGMDV

SEQ ID NO: 23861 - protein, 9 aa, Homo sapiens
  Light chain CDR3 for antibody 11931 (IGKV1D-16)
QHYNDYPFT

SEQ ID NO: 23862 - protein, 12 aa, Homo sapiens
  Heavy chain CDR3 for antibody 11931 (IGHV3-13)
ARDRGYSGYFDY

SEQ ID NO: 23863 - protein, 9 aa, Homo sapiens
  Light chain CDR3 for antibody 11932 (IGKV6-21)
HQSSSLPYT

SEQ ID NO: 23864 - protein, 15 aa, Homo sapiens
  Heavy chain CDR3 for antibody 11932 (IGHV3-64)
ARDSHHDLLTGHYEY

SEQ ID NO: 23865 - protein, 9 aa, Homo sapiens
  Light chain CDR3 for antibody 11933 (IGKV6-21)
HQSTSLPFA

SEQ ID NO: 23866 - protein, 9 aa, Homo sapiens
  Heavy chain CDR3 for antibody 11933 (IGHV3-30)
ARPNWGFDY

SEQ ID NO: 23867 - protein, 10 aa, Homo sapiens
  Light chain CDR3 for antibody 11934 (IGKV3-11)
QQRSNWPPYT

SEQ ID NO: 23868 - protein, 10 aa, Homo sapiens
  Heavy chain CDR3 for antibody 11934 (IGHV3-30)
ARGSWYGFDY

SEQ ID NO: 23869 - protein, 10 aa, Homo sapiens
  Light chain CDR3 for antibody 11935 (IGKV1-17)
QQLDSYPMYT

SEQ ID NO: 23870 - protein, 15 aa, Homo sapiens
  Heavy chain CDR3 for antibody 11935 (IGHV3-33)
ARDHLTGYYYYGMDV

SEQ ID NO: 23871 - protein, 9 aa, Homo sapiens
  Light chain CDR3 for antibody 11936 (IGKV1-9)
QQLKSYLYT

SEQ ID NO: 23872 - protein, 15 aa, Homo sapiens
  Heavy chain CDR3 for antibody 11936 (IGHV3-33)
ARRICSGGSCSLFDY

SEQ ID NO: 23873 - protein, 9 aa, Homo sapiens
  Light chain CDR3 for antibody 11937 (IGKV1-6)
LQDYNYPRT

SEQ ID NO: 23874 - protein, 13 aa, Homo sapiens
  Heavy chain CDR3 for antibody 11937 (IGHV3-33)
ARGDGDILTGYSL

SEQ ID NO: 23875 - protein, 9 aa, Homo sapiens
  Light chain CDR3 for antibody 11938 (IGKV1-27)
QKYNSAPYT

SEQ ID NO: 23876 - protein, 23 aa, Homo sapiens
  Heavy chain CDR3 for antibody 11938 (IGHV4-59)
ARERTYSGILPGYYEDYYYGMDV

SEQ ID NO: 23877 - protein, 9 aa, Homo sapiens
  Light chain CDR3 for antibody 11939 (IGKV3-20)
QHYGSSPYT

SEQ ID NO: 23878 - protein, 9 aa, Homo sapiens
  Heavy chain CDR3 for antibody 11939 (IGHV4-59)
ARGGVHIDS

SEQ ID NO: 23879 - protein, 9 aa, Homo sapiens
  Light chain CDR3 for antibody 11940 (IGKV1D-16)
QQYNSFPLT

SEQ ID NO: 23880 - protein, 11 aa, Homo sapiens
  Heavy chain CDR3 for antibody 11940 (IGHV4-59)
AREMGHDAFDI

SEQ ID NO: 23881 - protein, 10 aa, Homo sapiens
  Light chain CDR3 for antibody 11941 (IGKV3-20)
QQYGSSPPYT

SEQ ID NO: 23882 - protein, 20 aa, Homo sapiens
  Heavy chain CDR3 for antibody 11941 (IGHV3-33)
ARDWMVRGVIITDYYYGMDV

SEQ ID NO: 23883 - protein, 9 aa, Homo sapiens
  Light chain CDR3 for antibody 11942 (IGKV1-9)
QQLNSYPLT

SEQ ID NO: 23884 - protein, 12 aa, Homo sapiens
  Heavy chain CDR3 for antibody 11942 (IGHV1-18)
STSDGSSTSFDY

SEQ ID NO: 23885 - protein, 9 aa, Homo sapiens
  Light chain CDR3 for antibody 11943 (IGKV6-21)
HQSSSLPLT

SEQ ID NO: 23886 - protein, 15 aa, Homo sapiens
  Heavy chain CDR3 for antibody 11943 (IGHV3-33)
ARRVCSGGSCSLFDY

SEQ ID NO: 23887 - protein, 9 aa, Homo sapiens
  Light chain CDR3 for antibody 11944 (IGKV2D-28)
MQALQTPRT

SEQ ID NO: 23888 - protein, 20 aa, Homo sapiens
  Heavy chain CDR3 for antibody 11944 (IGHV3-23)
AKDREMAATSHYYYYYGMDV

SEQ ID NO: 23889 - protein, 9 aa, Homo sapiens
  Light chain CDR3 for antibody 11945 (IGKV1-6)
LQDYNYPWT

SEQ ID NO: 23890 - protein, 7 aa, Homo sapiens
  Heavy chain CDR3 for antibody 11945 (IGHV1-46)
AREGGDY

SEQ ID NO: 23891 - protein, 9 aa, Homo sapiens
  Light chain CDR3 for antibody 11946 (IGKV5-2)
LQHAKFPYT

SEQ ID NO: 23892 - protein, 12 aa, Homo sapiens
  Heavy chain CDR3 for antibody 11946 (IGHV3-33)
AREKGGSYSFDY

SEQ ID NO: 23893 - protein, 9 aa, Homo sapiens
  Light chain CDR3 for antibody 11947 (IGKV1-17)
LQHNSYPYT

SEQ ID NO: 23894 - protein, 13 aa, Homo sapiens
  Heavy chain CDR3 for antibody 11947 (IGHV3-33)
ARGGYYGSGSLDY

SEQ ID NO: 23895 - protein, 9 aa, Homo sapiens
  Light chain CDR3 for antibody 11948 (IGKV1D-16)
QQYHSYPYT

SEQ ID NO: 23896 - protein, 17 aa, Homo sapiens
  Heavy chain CDR3 for antibody 11948 (IGHV1-24)
TTVVLYYDILPGYSLDY

SEQ ID NO: 23897 - protein, 8 aa, Homo sapiens
  Light chain CDR3 for antibody 11949 (IGKV3-15)
QQYNNWPT

SEQ ID NO: 23898 - protein, 24 aa, Homo sapiens
  Heavy chain CDR3 for antibody 11949 (IGHV3-20)
ARGRITMVRGVIIDPLDYYNGMDV

SEQ ID NO: 23899 - protein, 9 aa, Homo sapiens
  Light chain CDR3 for antibody 11950 (IGKV3-11)
QQRSNWPYT

SEQ ID NO: 23900 - protein, 14 aa, Homo sapiens
  Heavy chain CDR3 for antibody 11950 (IGHV3-33)
VSAISGSSYWYFAL

SEQ ID NO: 23901 - protein, 9 aa, Homo sapiens
  Light chain CDR3 for antibody 11951 (IGKV1-6)
LQDYKSPFT

SEQ ID NO: 23902 - protein, 13 aa, Homo sapiens
  Heavy chain CDR3 for antibody 11951 (IGHV3-23)
AKDRGYSSTSTAY

SEQ ID NO: 23903 - protein, 10 aa, Homo sapiens
  Light chain CDR3 for antibody 11952 (IGKV3-15)
QQYNNWPPIT

SEQ ID NO: 23904 - protein, 15 aa, Homo sapiens
  Heavy chain CDR3 for antibody 11952 (IGHV3-23)
AKDGSYYDYYYGMDV

SEQ ID NO: 23905 - protein, 9 aa, Homo sapiens
  Light chain CDR3 for antibody 11953 (IGKV1-9)
QQLYTYPYT

SEQ ID NO: 23906 - protein, 17 aa, Homo sapiens
  Heavy chain CDR3 for antibody 11953 (IGHV3-33)
ARCGYSSSWYDAYYFDY

SEQ ID NO: 23907 - protein, 9 aa, Homo sapiens
  Light chain CDR3 for antibody 11954 (IGKV1-17)
LQHNSYPFT

SEQ ID NO: 23908 - protein, 18 aa, Homo sapiens
  Heavy chain CDR3 for antibody 11954 (IGHV3-20)
ARDPSGYDSYYYYYGMDV

SEQ ID NO: 23909 - protein, 9 aa, Homo sapiens
  Light chain CDR3 for antibody 11955 (IGKV1D-13)
QHFNNYMYT

SEQ ID NO: 23910 - protein, 16 aa, Homo sapiens
  Heavy chain CDR3 for antibody 11955 (IGHV4-39)
ARQGWYYGSGSSYFDY

SEQ ID NO: 23911 - protein, 9 aa, Homo sapiens
  Light chain CDR3 for antibody 11956 (IGKV1-39)
QQSYSTPLT

SEQ ID NO: 23912 - protein, 15 aa, Homo sapiens
  Heavy chain CDR3 for antibody 11956 (IGHV3-33)
AKGGTMVRGVIAFDY

SEQ ID NO: 23913 - protein, 10 aa, Homo sapiens
  Light chain CDR3 for antibody 11957 (IGKV3-11)
QQRSNWPALA

SEQ ID NO: 23914 - protein, 15 aa, Homo sapiens
  Heavy chain CDR3 for antibody 11957 (IGHV3-20)
ARDRGSSGWRDWFDP

SEQ ID NO: 23915 - protein, 9 aa, Homo sapiens
  Light chain CDR3 for antibody 11958 (IGKV1-9)
QQLNTYPWT

SEQ ID NO: 23916 - protein, 13 aa, Homo sapiens
  Heavy chain CDR3 for antibody 11958 (IGHV3-33)
AKRYSSGWYPFDF

SEQ ID NO: 23917 - protein, 8 aa, Homo sapiens
  Light chain CDR3 for antibody 11959 (IGKV3-11)
QQRSNWLT

SEQ ID NO: 23918 - protein, 12 aa, Homo sapiens
  Heavy chain CDR3 for antibody 11959 (IGHV4-39)
ARQMVREGWFDP

SEQ ID NO: 23919 - protein, 9 aa, Homo sapiens
  Light chain CDR3 for antibody 11960 (IGKV1D-13)
QQFNNYPYT

SEQ ID NO: 23920 - protein, 14 aa, Homo sapiens
  Heavy chain CDR3 for antibody 11960 (IGHV3-33)
ARETSGSSYWYFDL

SEQ ID NO: 23921 - protein, 9 aa, Homo sapiens
  Light chain CDR3 for antibody 11961 (IGKV1D-16)
QQYNSYPLT

SEQ ID NO: 23922 - protein, 17 aa, Homo sapiens
  Heavy chain CDR3 for antibody 11961 (IGHV3-64)
ARERYYGSGSYYSWFDP

SEQ ID NO: 23923 - protein, 9 aa, Homo sapiens
  Light chain CDR3 for antibody 11962 (IGKV3D-7)
QQDYNLPYT

SEQ ID NO: 23924 - protein, 14 aa, Homo sapiens
  Heavy chain CDR3 for antibody 11962 (IGHV3-20)
ARDRGSSFFDAFDI

SEQ ID NO: 23925 - protein, 9 aa, Homo sapiens
  Light chain CDR3 for antibody 11963 (IGKV2D-30)
MQGTHWPLT

SEQ ID NO: 23926 - protein, 13 aa, Homo sapiens
  Heavy chain CDR3 for antibody 11963 (IGHV3-11)
AREGGYRGYVLDN

SEQ ID NO: 23927 - protein, 9 aa, Homo sapiens
  Light chain CDR3 for antibody 11964 (IGKV3D-7)
QQEYNYPLT

SEQ ID NO: 23928 - protein, 14 aa, Homo sapiens
  Heavy chain CDR3 for antibody 11964 (IGHV1-46)
ARDGVGAKEGGSDY

SEQ ID NO: 23929 - protein, 11 aa, Homo sapiens
  Light chain CDR3 for antibody 11965 (IGKV3-11)
QQRSNCPPTWT

SEQ ID NO: 23930 - protein, 14 aa, Homo sapiens
  Heavy chain CDR3 for antibody 11965 (IGHV3-33)
ARDRIAAASSDFDC

SEQ ID NO: 23931 - protein, 9 aa, Homo sapiens
  Light chain CDR3 for antibody 11966 (IGKV1-6)
QQEYNYPLT

SEQ ID NO: 23932 - protein, 19 aa, Homo sapiens
  Heavy chain CDR3 for antibody 11966 (IGHV1-18)
ARDDILTGYSLYYYYGMDV

SEQ ID NO: 23933 - protein, 8 aa, Homo sapiens
  Light chain CDR3 for antibody 11967 (IGKV6-21)
HQSSSLPT

SEQ ID NO: 23934 - protein, 26 aa, Homo sapiens
  Heavy chain CDR3 for antibody 11967 (IGHV4-39)
ARQGLLWFGDLKAYDSSGYYYGYFHH

SEQ ID NO: 23935 - protein, 10 aa, Homo sapiens
  Light chain CDR3 for antibody 11968 (IGKV3-11)
QQRSNWPALT

SEQ ID NO: 23936 - protein, 11 aa, Homo sapiens
  Heavy chain CDR3 for antibody 11968 (IGHV4-39)
ARLLVGATTDY

SEQ ID NO: 23937 - protein, 10 aa, Homo sapiens
  Light chain CDR3 for antibody 11969 (IGKV3-15)
QQYNNWPPIT

SEQ ID NO: 23938 - protein, 12 aa, Homo sapiens
  Heavy chain CDR3 for antibody 11969 (IGHV3-13)
ARDRGYSGYIDY

SEQ ID NO: 23939 - protein, 9 aa, Homo sapiens
  Light chain CDR3 for antibody 11970 (IGKV1-17)
LQHYSYPRT

SEQ ID NO: 23940 - protein, 13 aa, Homo sapiens
  Heavy chain CDR3 for antibody 11970 (IGHV4-39)
ARHEVMIRGVLDY

SEQ ID NO: 23941 - protein, 10 aa, Homo sapiens
  Light chain CDR3 for antibody 11971 (IGKV3-15)
QQYNNWPPYT

SEQ ID NO: 23942 - protein, 15 aa, Homo sapiens
  Heavy chain CDR3 for antibody 11971 (IGHV4-39)
ARQGLVATIKGYFQH

SEQ ID NO: 23943 - protein, 10 aa, Homo sapiens
  Light chain CDR3 for antibody 11972 (IGKV3-11)
QQRSNWPIFT

SEQ ID NO: 23944 - protein, 14 aa, Homo sapiens
  Heavy chain CDR3 for antibody 11972 (IGHV3-23)
AKCDYDILTGILDY

SEQ ID NO: 23945 - protein, 9 aa, Homo sapiens
  Light chain CDR3 for antibody 11973 (IGKV1-17)
LQHNGYPLT

SEQ ID NO: 23946 - protein, 13 aa, Homo sapiens
  Heavy chain CDR3 for antibody 11973 (IGHV4-39)
ARHEVMIRGVFDY

SEQ ID NO: 23947 - protein, 10 aa, Homo sapiens
  Light chain CDR3 for antibody 11974 (IGKV3-11)
QQRSNWPILT

SEQ ID NO: 23948 - protein, 14 aa, Homo sapiens
  Heavy chain CDR3 for antibody 11974 (IGHV3-33)
ARGGYSGYRYYFDY

SEQ ID NO: 23949 - protein, 9 aa, Homo sapiens
  Light chain CDR3 for antibody 11975 (IGKV1-6)
LQDFHYPWT

SEQ ID NO: 23950 - protein, 11 aa, Homo sapiens
  Heavy chain CDR3 for antibody 11975 (IGHV4-59)
AREMGHDTFDI

SEQ ID NO: 23951 - protein, 9 aa, Homo sapiens
  Light chain CDR3 for antibody 11976 (IGKV1-9)
QQLISYPLT

SEQ ID NO: 23952 - protein, 18 aa, Homo sapiens
  Heavy chain CDR3 for antibody 11976 (IGHV3-33)
AREGDYVWGSYRPNWFDP

SEQ ID NO: 23953 - protein, 9 aa, Homo sapiens
  Light chain CDR3 for antibody 11977 (IGKV3D-7)
QQDYNLPYT

SEQ ID NO: 23954 - protein, 13 aa, Homo sapiens
  Heavy chain CDR3 for antibody 11977 (IGHV3-11)
ARDEGYRGYGLDS

SEQ ID NO: 23955 - protein, 10 aa, Homo sapiens
  Light chain CDR3 for antibody 11978 (IGKV3-20)
QQYGRSPPVT

SEQ ID NO: 23956 - protein, 15 aa, Homo sapiens
  Heavy chain CDR3 for antibody 11978 (IGHV3-20)
ARDRGSSGWRDWFDP

SEQ ID NO: 23957 - protein, 8 aa, Homo sapiens
  Light chain CDR3 for antibody 11979 (IGKV3D-7)
QQDYNLLT

SEQ ID NO: 23958 - protein, 15 aa, Homo sapiens
  Heavy chain CDR3 for antibody 11979 (IGHV3-33)
ARDRGSSGYDRYFDY

SEQ ID NO: 23959 - protein, 10 aa, Homo sapiens
  Light chain CDR3 for antibody 11980 (IGKV3-11)
QQRSNWPMYT

SEQ ID NO: 23960 - protein, 9 aa, Homo sapiens
  Heavy chain CDR3 for antibody 11980 (IGHV1-8)
ARGRLDFDY

SEQ ID NO: 23961 - protein, 10 aa, Homo sapiens
  Light chain CDR3 for antibody 11981 (IGKV1-27)
QKYNSAPMYT

SEQ ID NO: 23962 - protein, 14 aa, Homo sapiens
  Heavy chain CDR3 for antibody 11981 (IGHV3-33)
ARGAAAGNFYGLDV

SEQ ID NO: 23963 - protein, 9 aa, Homo sapiens
  Light chain CDR3 for antibody 11982 (IGKV1-9)
QQLSNAPLT

SEQ ID NO: 23964 - protein, 17 aa, Homo sapiens
  Heavy chain CDR3 for antibody 11982 (IGHV3-23)
AKRLPDLLGGGRHYIDV

SEQ ID NO: 23965 - protein, 9 aa, Homo sapiens
  Light chain CDR3 for antibody 11983 (IGKV1-6)
LQVYSYPWT

SEQ ID NO: 23966 - protein, 17 aa, Homo sapiens
  Heavy chain CDR3 for antibody 11983 (IGHV3-33)
ARGYCSRTSCYLYYFDY

SEQ ID NO: 23967 - protein, 8 aa, Homo sapiens
  Light chain CDR3 for antibody 11984 (IGKV3-20)
QQYGSSFT

SEQ ID NO: 23968 - protein, 13 aa, Homo sapiens
  Heavy chain CDR3 for antibody 11984 (IGHV3-33)
AKRYSSGWYPFDF

SEQ ID NO: 23969 - protein, 9 aa, Homo sapiens
  Light chain CDR3 for antibody 11985 (IGKV1-16)
QQYHSYPYT

SEQ ID NO: 23970 - protein, 15 aa, Homo sapiens
  Heavy chain CDR3 for antibody 11985 (IGHV4-59)
ARDRAVAGTIHAFGI

SEQ ID NO: 23971 - protein, 9 aa, Homo sapiens
  Light chain CDR3 for antibody 11986 (IGKV1-5)
QQYNTYSRT

SEQ ID NO: 23972 - protein, 17 aa, Homo sapiens
  Heavy chain CDR3 for antibody 11986 (IGHV3-h)
ARGEQWLGYYYYYDMDV

SEQ ID NO: 23973 - protein, 8 aa, Homo sapiens
  Light chain CDR3 for antibody 11987 (IGKV1-5)
QQYNSYWT

SEQ ID NO: 23974 - protein, 9 aa, Homo sapiens
  Heavy chain CDR3 for antibody 11987 (IGHV1-8)
ARERLDLDY

SEQ ID NO: 23975 - protein, 9 aa, Homo sapiens
  Light chain CDR3 for antibody 11988 (IGKV6-21)
HQSSSLPYT

SEQ ID NO: 23976 - protein, 23 aa, Homo sapiens
  Heavy chain CDR3 for antibody 11988 (IGHV3-33)
ARDRGITMVRGVITYYYFYGMDV

SEQ ID NO: 23977 - protein, 9 aa, Homo sapiens
  Light chain CDR3 for antibody 11989 (IGKV1-6)
LQDFHYPWT

SEQ ID NO: 23978 - protein, 12 aa, Homo sapiens
  Heavy chain CDR3 for antibody 11989 (IGHV3-33)
ARGYFGSGYAHF

SEQ ID NO: 23979 - protein, 9 aa, Homo sapiens
  Light chain CDR3 for antibody 11990 (IGKV5-2)
LQHDKFLYT

SEQ ID NO: 23980 - protein, 18 aa, Homo sapiens
  Heavy chain CDR3 for antibody 11990 (IGHV3-33)
ARGGYSSGWDYYYYGMDV

SEQ ID NO: 23981 - protein, 9 aa, Homo sapiens
  Light chain CDR3 for antibody 11991 (IGKV1-6)
QQDYEFPLT

SEQ ID NO: 23982 - protein, 18 aa, Homo sapiens
  Heavy chain CDR3 for antibody 11991 (IGHV4-59)
AKDRITGTTYGYYSGLDV

SEQ ID NO: 23983 - protein, 9 aa, Homo sapiens
  Light chain CDR3 for antibody 11992 (IGKV3D-20)
QQYGSGPWT

SEQ ID NO: 23984 - protein, 18 aa, Homo sapiens
  Heavy chain CDR3 for antibody 11992 (IGHV3-33)
AREGYDILTGYYNVKFDY

SEQ ID NO: 23985 - protein, 8 aa, Homo sapiens
  Light chain CDR3 for antibody 11993 (IGKV6-21)
HQSSSLYT

SEQ ID NO: 23986 - protein, 12 aa, Homo sapiens
  Heavy chain CDR3 for antibody 11993 (IGHV4-61)
ARVGSSGWYFDY

SEQ ID NO: 23987 - protein, 8 aa, Homo sapiens
  Light chain CDR3 for antibody 11994 (IGKV3-11)
QQRSNWLT

SEQ ID NO: 23988 - protein, 9 aa, Homo sapiens
  Heavy chain CDR3 for antibody 11994 (IGHV1-8)
ARGPRIMDV

SEQ ID NO: 23989 - protein, 9 aa, Homo sapiens
  Light chain CDR3 for antibody 11995 (IGKV1D-13)
QHFNNYMYT

SEQ ID NO: 23990 - protein, 16 aa, Homo sapiens
  Heavy chain CDR3 for antibody 11995 (IGHV4-b)
ARDTPYYSGSGRPFDH

SEQ ID NO: 23991 - protein, 9 aa, Homo sapiens
  Light chain CDR3 for antibody 11996 (IGKV1-9)
QQLISYPLT

SEQ ID NO: 23992 - protein, 17 aa, Homo sapiens
  Heavy chain CDR3 for antibody 11996 (IGHV3-33)
ARSPYDILTGYSYYFDY

SEQ ID NO: 23993 - protein, 9 aa, Homo sapiens
  Light chain CDR3 for antibody 11997 (IGKV6-21)
HQSSSLPHT

SEQ ID NO: 23994 - protein, 15 aa, Homo sapiens
  Heavy chain CDR3 for antibody 11997 (IGHV3-33)
AKGGTMVRGVIAFDY

SEQ ID NO: 23995 - protein, 8 aa, Homo sapiens
  Light chain CDR3 for antibody 11998 (IGKV6-21)
HQSSSLPH

SEQ ID NO: 23996 - protein, 18 aa, Homo sapiens
  Heavy chain CDR3 for antibody 11998 (IGHV3-23)
AKEGNYYGSGSYWGYFDP

SEQ ID NO: 23997 - protein, 9 aa, Homo sapiens
  Light chain CDR3 for antibody 11999 (IGKV1-6)
QQYDNLPFT

SEQ ID NO: 23998 - protein, 16 aa, Homo sapiens
  Heavy chain CDR3 for antibody 11999 (IGHV3-33)
ARGYDMLTGDYYGMDV

SEQ ID NO: 23999 - protein, 10 aa, Homo sapiens
  Light chain CDR3 for antibody 12000 (IGKV3-20)
QQYGSSPPYT

SEQ ID NO: 24000 - protein, 13 aa, Homo sapiens
  Heavy chain CDR3 for antibody 12000 (IGHV3-33)
ARIDYYSYYGMDV

SEQ ID NO: 24001 - protein, 9 aa, Homo sapiens
  Light chain CDR3 for antibody 12001 (IGKV1-9)
QQLNRYPYT

SEQ ID NO: 24002 - protein, 16 aa, Homo sapiens
  Heavy chain CDR3 for antibody 12001 (IGHV3-23)
ARDLGIAAAGTGWFDP

SEQ ID NO: 24003 - protein, 9 aa, Homo sapiens
  Light chain CDR3 for antibody 12002 (IGKV1-6)
LQDYNYPYT

SEQ ID NO: 24004 - protein, 12 aa, Homo sapiens
  Heavy chain CDR3 for antibody 12002 (IGHV1-18)
ARAPYNWNDPDY

SEQ ID NO: 24005 - protein, 6 aa, Homo sapiens
  Light chain CDR3 for antibody 12003 (IGKV3-20)
QQYGST

SEQ ID NO: 24006 - protein, 14 aa, Homo sapiens
  Heavy chain CDR3 for antibody 12003 (IGHV3-33)
ARQYSYGYPYYFDY

SEQ ID NO: 24007 - protein, 9 aa, Homo sapiens
  Light chain CDR3 for antibody 12004 (IGKV2-30)
MQGTHWPLT

SEQ ID NO: 24008 - protein, 16 aa, Homo sapiens
  Heavy chain CDR3 for antibody 12004 (IGHV3-33)
ARDRGGMTMVRGGFDY

SEQ ID NO: 24009 - protein, 8 aa, Homo sapiens
  Light chain CDR3 for antibody 12005 (IGKV1-5)
QQYNSYYT

SEQ ID NO: 24010 - protein, 17 aa, Homo sapiens
  Heavy chain CDR3 for antibody 12005 (IGHV3-33)
ARENDILTGSYYYGMDV

SEQ ID NO: 24011 - protein, 9 aa, Homo sapiens
  Light chain CDR3 for antibody 12006 (IGKV1-6)
LQDYNYPWT

SEQ ID NO: 24012 - protein, 11 aa, Homo sapiens
  Heavy chain CDR3 for antibody 12006 (IGHV3-33)
ARDRILTPFDY

SEQ ID NO: 24013 - protein, 9 aa, Homo sapiens
  Light chain CDR3 for antibody 12007 (IGKV1D-16)
QQYNSYPYT

SEQ ID NO: 24014 - protein, 18 aa, Homo sapiens
  Heavy chain CDR3 for antibody 12007 (IGHV3-33)
AKDGYDILTGYYYYYFDL

SEQ ID NO: 24015 - protein, 9 aa, Homo sapiens
  Light chain CDR3 for antibody 12008 (IGKV1D-13)
QHFNNYMYT

SEQ ID NO: 24016 - protein, 20 aa, Homo sapiens
  Heavy chain CDR3 for antibody 12008 (IGHV3-33)
AREDYYGSGSYYPAYNWFDP

SEQ ID NO: 24017 - protein, 9 aa, Homo sapiens
  Light chain CDR3 for antibody 12009 (IGKV1-6)
LQDFNYPRT

SEQ ID NO: 24018 - protein, 15 aa, Homo sapiens
  Heavy chain CDR3 for antibody 12009 (IGHV4-59)
ARRDYDISTGYLFDY

SEQ ID NO: 24019 - protein, 8 aa, Homo sapiens
  Light chain CDR3 for antibody 12010 (IGKV3D-7)
QQDYNLLT

SEQ ID NO: 24020 - protein, 10 aa, Homo sapiens
  Heavy chain CDR3 for antibody 12010 (IGHV3-33)
ARVVDTAMAY

SEQ ID NO: 24021 - protein, 9 aa, Homo sapiens
  Light chain CDR3 for antibody 12011 (IGKV3-11)
QQRSNWQYT

SEQ ID NO: 24022 - protein, 13 aa, Homo sapiens
  Heavy chain CDR3 for antibody 12011 (IGHV1-18)
ARGGGVRGAPLDY

SEQ ID NO: 24023 - protein, 10 aa, Homo sapiens
  Light chain CDR3 for antibody 12012 (IGKV3-15)
QQYNNWPPIT

SEQ ID NO: 24024 - protein, 10 aa, Homo sapiens
  Heavy chain CDR3 for antibody 12012 (IGHV3-33)
ARDVVVYFDY

SEQ ID NO: 24025 - protein, 9 aa, Homo sapiens
  Light chain CDR3 for antibody 12013 (IGKV3-11)
QQRSNWPPT

SEQ ID NO: 24026 - protein, 17 aa, Homo sapiens
  Heavy chain CDR3 for antibody 12013 (IGHV3-33)
ARDPARGNVRSFYGLDV

SEQ ID NO: 24027 - protein, 9 aa, Homo sapiens
  Light chain CDR3 for antibody 12014 (IGKV1-9)
QQLHIYPWT

SEQ ID NO: 24028 - protein, 15 aa, Homo sapiens
  Heavy chain CDR3 for antibody 12014 (IGHV3-33)
ARGYYYGSGSFPVDY

SEQ ID NO: 24029 - protein, 10 aa, Homo sapiens
  Light chain CDR3 for antibody 12015 (IGKV3-15)
QQYNNWPPYT

SEQ ID NO: 24030 - protein, 13 aa, Homo sapiens
  Heavy chain CDR3 for antibody 12015 (IGHV3-23)
ASPFNWNDGFFDY

SEQ ID NO: 24031 - protein, 9 aa, Homo sapiens
  Light chain CDR3 for antibody 12016 (IGKV3-20)
QQYGTSPFP

SEQ ID NO: 24032 - protein, 18 aa, Homo sapiens
  Heavy chain CDR3 for antibody 12016 (IGHV3-33)
ARREGIVGATTYYYGMDV

SEQ ID NO: 24033 - protein, 9 aa, Homo sapiens
  Light chain CDR3 for antibody 12017 (IGKV2-24)
MQATQFPHT

SEQ ID NO: 24034 - protein, 14 aa, Homo sapiens
  Heavy chain CDR3 for antibody 12017 (IGHV3-33)
ARAISGSSYWYFDL

SEQ ID NO: 24035 - protein, 10 aa, Homo sapiens
  Light chain CDR3 for antibody 12018 (IGKV3-11)
QQRSNWPALT

SEQ ID NO: 24036 - protein, 11 aa, Homo sapiens
  Heavy chain CDR3 for antibody 12018 (IGHV4-59)
VRERGYYGMDV

SEQ ID NO: 24037 - protein, 9 aa, Homo sapiens
  Light chain CDR3 for antibody 12019 (IGKV3D-7)
QQDYEFPLT

SEQ ID NO: 24038 - protein, 11 aa, Homo sapiens
  Heavy chain CDR3 for antibody 12019 (IGHV4-59)
ARDRGHYGMDV

SEQ ID NO: 24039 - protein, 10 aa, Homo sapiens
  Light chain CDR3 for antibody 12020 (IGKV1-17)
LQHNSYPIYT

SEQ ID NO: 24040 - protein, 18 aa, Homo sapiens
  Heavy chain CDR3 for antibody 12020 (IGHV4-39)
ARQYYFGSGNYYRGWFDP

SEQ ID NO: 24041 - protein, 10 aa, Homo sapiens
  Light chain CDR3 for antibody 12021 (IGKV1-6)
LQDYNYPMYT

SEQ ID NO: 24042 - protein, 18 aa, Homo sapiens
  Heavy chain CDR3 for antibody 12021 (IGHV3-33)
ARDGRISLVRGIIDAFDI

SEQ ID NO: 24043 - protein, 9 aa, Homo sapiens
  Light chain CDR3 for antibody 12022 (IGKV1-6)
LQDYNYPYT

SEQ ID NO: 24044 - protein, 11 aa, Homo sapiens
  Heavy chain CDR3 for antibody 12022 (IGHV4-59)
AREMGHDILDI

SEQ ID NO: 24045 - protein, 10 aa, Homo sapiens
  Light chain CDR3 for antibody 12023 (IGKV1D-13)
LQDYNYPMYT

SEQ ID NO: 24046 - protein, 18 aa, Homo sapiens
  Heavy chain CDR3 for antibody 12023 (IGHV3-33)
ARDGYSGYDYYYYYGMDV

SEQ ID NO: 24047 - protein, 10 aa, Homo sapiens
  Light chain CDR3 for antibody 12024 (IGKV1-17)
LQHNSYPMYT

SEQ ID NO: 24048 - protein, 15 aa, Homo sapiens
  Heavy chain CDR3 for antibody 12024 (IGHV3-23)
AKDLSSGWYAYFFDY

SEQ ID NO: 24049 - protein, 10 aa, Homo sapiens
  Light chain CDR3 for antibody 12025 (IGKV3-15)
QQYNNWPPYT

SEQ ID NO: 24050 - protein, 15 aa, Homo sapiens
  Heavy chain CDR3 for antibody 12025 (IGHV3-23)
AKEALRYFDWSGMDV

SEQ ID NO: 24051 - protein, 7 aa, Homo sapiens
  Light chain CDR3 for antibody 12026 (IGKV1-17)
LQHNSYP

SEQ ID NO: 24052 - protein, 20 aa, Homo sapiens
  Heavy chain CDR3 for antibody 12026 (IGHV1-f)
ATGLITFARGVILTYRSFDY

SEQ ID NO: 24053 - protein, 9 aa, Homo sapiens
  Light chain CDR3 for antibody 12027 (IGKV1-33)
QQYDNLPFT

SEQ ID NO: 24054 - protein, 18 aa, Homo sapiens
  Heavy chain CDR3 for antibody 12027 (IGHV3-53)
AKAGDYYVSGSYWGYFDL

SEQ ID NO: 24055 - protein, 8 aa, Homo sapiens
  Light chain CDR3 for antibody 12028 (IGKV3D-7)
QQDYSLLT

SEQ ID NO: 24056 - protein, 16 aa, Homo sapiens
  Heavy chain CDR3 for antibody 12028 (IGHV3-33)
ARDRGGMTMVRGGFDY

SEQ ID NO: 24057 - protein, 10 aa, Homo sapiens
  Light chain CDR3 for antibody 12029 (IGKV1-17)
LQHNSYPMYT

SEQ ID NO: 24058 - protein, 15 aa, Homo sapiens
  Heavy chain CDR3 for antibody 12029 (IGHV3-30)
ARDSRPEITGPPFDY

SEQ ID NO: 24059 - protein, 9 aa, Homo sapiens
  Light chain CDR3 for antibody 12030 (IGKV3-11)
QQRSNWPYT

SEQ ID NO: 24060 - protein, 18 aa, Homo sapiens
  Heavy chain CDR3 for antibody 12030 (IGHV3-33)
ARERYYYGSGSYPDAFDI

SEQ ID NO: 24061 - protein, 9 aa, Homo sapiens
  Light chain CDR3 for antibody 12031 (IGKV1-17)
LHSNNYPWT

SEQ ID NO: 24062 - protein, 11 aa, Homo sapiens
  Heavy chain CDR3 for antibody 12031 (IGHV3-74)
ARDRGNWGFDY

SEQ ID NO: 24063 - protein, 9 aa, Homo sapiens
  Light chain CDR3 for antibody 12032 (IGKV1D-16)
QQFNNYPYT

SEQ ID NO: 24064 - protein, 14 aa, Homo sapiens
  Heavy chain CDR3 for antibody 12032 (IGHV3-33)
ARASSGSSYWYIDL

SEQ ID NO: 24065 - protein, 9 aa, Homo sapiens
  Light chain CDR3 for antibody 12033 (IGKV1-39)
QQSYSTPFI

SEQ ID NO: 24066 - protein, 14 aa, Homo sapiens
  Heavy chain CDR3 for antibody 12033 (IGHV4-59)
ARGAAAGNFYGLDV

SEQ ID NO: 24067 - protein, 9 aa, Homo sapiens
  Light chain CDR3 for antibody 12034 (IGKV6-21)
HQSSSLPYT

SEQ ID NO: 24068 - protein, 15 aa, Homo sapiens
  Heavy chain CDR3 for antibody 12034 (IGHV4-39)
ARRSKYTSAWYPFDY

SEQ ID NO: 24069 - protein, 9 aa, Homo sapiens
  Light chain CDR3 for antibody 12035 (IGKV1-39)
QQSYSTPYT

SEQ ID NO: 24070 - protein, 18 aa, Homo sapiens
  Heavy chain CDR3 for antibody 12035 (IGHV4-39)
ARGALTYYDILTGYFFDY

SEQ ID NO: 24071 - protein, 9 aa, Homo sapiens
  Light chain CDR3 for antibody 12036 (IGKV1-6)
LQDYNYPYT

SEQ ID NO: 24072 - protein, 15 aa, Homo sapiens
  Heavy chain CDR3 for antibody 12036 (IGHV3-33)
ARDSGGGAGTLPFDY

SEQ ID NO: 24073 - protein, 9 aa, Homo sapiens
  Light chain CDR3 for antibody 12037 (IGKV1-27)
QKYNSAPYT

SEQ ID NO: 24074 - protein, 19 aa, Homo sapiens
  Heavy chain CDR3 for antibody 12037 (IGHV3-33)
ARGSDYDILTGYSSDAFDI

SEQ ID NO: 24075 - protein, 9 aa, Homo sapiens
  Light chain CDR3 for antibody 12038 (IGKV1-27)
QKYNSAPHT

SEQ ID NO: 24076 - protein, 15 aa, Homo sapiens
  Heavy chain CDR3 for antibody 12038 (IGHV3-33)
AKDRNSGYDWGGFDY

SEQ ID NO: 24077 - protein, 9 aa, Homo sapiens
  Light chain CDR3 for antibody 12039 (IGKV3-20)
QQYGSSPRT

SEQ ID NO: 24078 - protein, 16 aa, Homo sapiens
  Heavy chain CDR3 for antibody 12039 (IGHV3-33)
ARGSVSDILTGAYFDY

SEQ ID NO: 24079 - protein, 9 aa, Homo sapiens
  Light chain CDR3 for antibody 12040 (IGKV1-27)
QKYNSAPYT

SEQ ID NO: 24080 - protein, 14 aa, Homo sapiens
  Heavy chain CDR3 for antibody 12040 (IGHV4-39)
ARQGDILTGYSFDN

SEQ ID NO: 24081 - protein, 9 aa, Homo sapiens
  Light chain CDR3 for antibody 12041 (IGKV1-6)
QQEYNYPLT

SEQ ID NO: 24082 - protein, 11 aa, Homo sapiens
  Heavy chain CDR3 for antibody 12041 (IGHV4-59)
AREMGHDIFDI

SEQ ID NO: 24083 - protein, 8 aa, Homo sapiens
  Light chain CDR3 for antibody 12042 (IGKV3-20)
QQYGSSFT

SEQ ID NO: 24084 - protein, 13 aa, Homo sapiens
  Heavy chain CDR3 for antibody 12042 (IGHV3-53)
ARSGSYWGYYFDY

SEQ ID NO: 24085 - protein, 10 aa, Homo sapiens
  Light chain CDR3 for antibody 12043 (IGKV1-17)
LQHNSYPMYT

SEQ ID NO: 24086 - protein, 16 aa, Homo sapiens
  Heavy chain CDR3 for antibody 12043 (IGHV3-33)
ARDKNTDYDILTGFDY

SEQ ID NO: 24087 - protein, 10 aa, Homo sapiens
  Light chain CDR3 for antibody 12044 (IGKV3-11)
QQRSNWPIYT

SEQ ID NO: 24088 - protein, 12 aa, Homo sapiens
  Heavy chain CDR3 for antibody 12044 (IGHV3-33)
ARKGYDMHAFDI

SEQ ID NO: 24089 - protein, 9 aa, Homo sapiens
  Light chain CDR3 for antibody 12045 (IGKV5-2)
LQHDNFPWT

SEQ ID NO: 24090 - protein, 12 aa, Homo sapiens
  Heavy chain CDR3 for antibody 12045 (IGHV1-46)
ARALTVGASFDY

SEQ ID NO: 24091 - protein, 9 aa, Homo sapiens
  Light chain CDR3 for antibody 12046 (IGKV5-2)
LQHDNFPYT

SEQ ID NO: 24092 - protein, 18 aa, Homo sapiens
  Heavy chain CDR3 for antibody 12046 (IGHV3-33)
ARGAYSSGWDYYYYGMDA

SEQ ID NO: 24093 - protein, 9 aa, Homo sapiens
  Light chain CDR3 for antibody 12047 (IGKV1-16)
QHYNDYPFT

SEQ ID NO: 24094 - protein, 10 aa, Homo sapiens
  Heavy chain CDR3 for antibody 12047 (IGHV3-30)
ARGSWCGFDY

SEQ ID NO: 24095 - protein, 9 aa, Homo sapiens
  Light chain CDR3 for antibody 12048 (IGKV3-11)
QQRSNWMYT

SEQ ID NO: 24096 - protein, 9 aa, Homo sapiens
  Heavy chain CDR3 for antibody 12048 (IGHV3-23)
AKEQQLFDY

SEQ ID NO: 24097 - protein, 9 aa, Homo sapiens
  Light chain CDR3 for antibody 12049 (IGKV3-20)
QQYGTSPFP

SEQ ID NO: 24098 - protein, 16 aa, Homo sapiens
  Heavy chain CDR3 for antibody 12049 (IGHV3-30)
ARDIAVAGHVYYGMDV

SEQ ID NO: 24099 - protein, 8 aa, Homo sapiens
  Light chain CDR3 for antibody 12050 (IGKV3-15)
QQYNNWPT

SEQ ID NO: 24100 - protein, 15 aa, Homo sapiens
  Heavy chain CDR3 for antibody 12050 (IGHV3-33)
ARAYDLPHYYYGMDV

SEQ ID NO: 24101 - protein, 9 aa, Homo sapiens
  Light chain CDR3 for antibody 12051 (IGKV1-33)
QQYDNLPFT

SEQ ID NO: 24102 - protein, 18 aa, Homo sapiens
  Heavy chain CDR3 for antibody 12051 (IGHV3-33)
ARGAYSSGWDYYYYGMDV

SEQ ID NO: 24103 - protein, 10 aa, Homo sapiens
  Light chain CDR3 for antibody 12052 (IGKV3-20)
QQYGRSPPVT

SEQ ID NO: 24104 - protein, 20 aa, Homo sapiens
  Heavy chain CDR3 for antibody 12052 (IGHV1-18)
AREVGIAVAGTLYYYYGMDV

SEQ ID NO: 24105 - protein, 9 aa, Homo sapiens
  Light chain CDR3 for antibody 12053 (IGKV1-9)
QQLKSYLYT

SEQ ID NO: 24106 - protein, 13 aa, Homo sapiens
  Heavy chain CDR3 for antibody 12053 (IGHV3-33)
ARRATLVRGVFDP

SEQ ID NO: 24107 - protein, 8 aa, Homo sapiens
  Light chain CDR3 for antibody 12054 (IGKV3-20)
QQYGSSFT

SEQ ID NO: 24108 - protein, 15 aa, Homo sapiens
  Heavy chain CDR3 for antibody 12054 (IGHV3-33)
ARDSRPEIIGPPFDY

SEQ ID NO: 24109 - protein, 9 aa, Homo sapiens
  Light chain CDR3 for antibody 12055 (IGKV1-6)
LQVYSYPWT

SEQ ID NO: 24110 - protein, 13 aa, Homo sapiens
  Heavy chain CDR3 for antibody 12055 (IGHV4-34)
ASNFYYYYYGMDV

SEQ ID NO: 24111 - protein, 9 aa, Homo sapiens
  Light chain CDR3 for antibody 12056 (IGKV1-37)
QRTYNAPYT

SEQ ID NO: 24112 - protein, 19 aa, Homo sapiens
  Heavy chain CDR3 for antibody 12056 (IGHV3-33)
AREDYYGSGSYYNEDWFDP

SEQ ID NO: 24113 - protein, 9 aa, Homo sapiens
  Light chain CDR3 for antibody 12057 (IGKV1-17)
LRHNCYPYT

SEQ ID NO: 24114 - protein, 14 aa, Homo sapiens
  Heavy chain CDR3 for antibody 12057 (IGHV3-33)
ARDNILTAYYLFDY

SEQ ID NO: 24115 - protein, 9 aa, Homo sapiens
  Light chain CDR3 for antibody 12058 (IGKV1D-16)
QQYITYPYT

SEQ ID NO: 24116 - protein, 12 aa, Homo sapiens
  Heavy chain CDR3 for antibody 12058 (IGHV3-33)
ARDRAYRGSLDY

SEQ ID NO: 24117 - protein, 9 aa, Homo sapiens
  Light chain CDR3 for antibody 12059 (IGKV3D-7)
QQDYNLPYS

SEQ ID NO: 24118 - protein, 13 aa, Homo sapiens
  Heavy chain CDR3 for antibody 12059 (IGHV3-33)
ARGVLWFGELFDY

SEQ ID NO: 24119 - protein, 9 aa, Homo sapiens
  Light chain CDR3 for antibody 12060 (IGKV1-6)
QQYDNLPPT

SEQ ID NO: 24120 - protein, 10 aa, Homo sapiens
  Heavy chain CDR3 for antibody 12060 (IGHV3-33)
ARVVDTAMAY

SEQ ID NO: 24121 - protein, 9 aa, Homo sapiens
  Light chain CDR3 for antibody 12061 (IGKV2-30)
MQGTHWPLT

SEQ ID NO: 24122 - protein, 14 aa, Homo sapiens
  Heavy chain CDR3 for antibody 12061 (IGHV3-20)
AREGWFGDYYGMDV

SEQ ID NO: 24123 - protein, 8 aa, Homo sapiens
  Light chain CDR3 for antibody 12062 (IGKV1-5)
QQYNSYWT

SEQ ID NO: 24124 - protein, 20 aa, Homo sapiens
  Heavy chain CDR3 for antibody 12062 (IGHV3-33)
ARDPAQLERRYYYFYYGMDV

SEQ ID NO: 24125 - protein, 9 aa, Homo sapiens
  Light chain CDR3 for antibody 12063 (IGKV2-30)
MQGTHWPLT

SEQ ID NO: 24126 - protein, 10 aa, Homo sapiens
  Heavy chain CDR3 for antibody 12063 (IGHV3-30)
ARGSWYGFDY

SEQ ID NO: 24127 - protein, 10 aa, Homo sapiens
  Light chain CDR3 for antibody 12064 (IGKV3-11)
QQRSTWPTLI

SEQ ID NO: 24128 - protein, 13 aa, Homo sapiens
  Heavy chain CDR3 for antibody 12064 (IGHV3-23)
AKDRGYSSTSTAY

SEQ ID NO: 24129 - protein, 9 aa, Homo sapiens
  Light chain CDR3 for antibody 12065 (IGKV1D-13)
QQFNNYPHT

SEQ ID NO: 24130 - protein, 14 aa, Homo sapiens
  Heavy chain CDR3 for antibody 12065 (IGHV3-20)
ARDEGSTWSDIFDI

SEQ ID NO: 24131 - protein, 11 aa, Homo sapiens
  Light chain CDR3 for antibody 12066 (IGKV3-11)
QQRSNWPPTWP

SEQ ID NO: 24132 - protein, 13 aa, Homo sapiens
  Heavy chain CDR3 for antibody 12066 (IGHV4-39)
ARRDVLAPAAFEY

SEQ ID NO: 24133 - protein, 9 aa, Homo sapiens
  Light chain CDR3 for antibody 12067 (IGKV1-9)
QQLNTYPYT

SEQ ID NO: 24134 - protein, 9 aa, Homo sapiens
  Heavy chain CDR3 for antibody 12067 (IGHV3-13)
ARDHWYFDL

SEQ ID NO: 24135 - protein, 9 aa, Homo sapiens
  Light chain CDR3 for antibody 12068 (IGKV3D-20)
QQYGRSPRT

SEQ ID NO: 24136 - protein, 15 aa, Homo sapiens
  Heavy chain CDR3 for antibody 12068 (IGHV1-24)
ATDWNDRGYYYGMDV

SEQ ID NO: 24137 - protein, 9 aa, Homo sapiens
  Light chain CDR3 for antibody 12069 (IGKV3-11)
QQRINWPPT

SEQ ID NO: 24138 - protein, 14 aa, Homo sapiens
  Heavy chain CDR3 for antibody 12069 (IGHV3-20)
AREGWFGDYYGMDV

SEQ ID NO: 24139 - protein, 9 aa, Homo sapiens
  Light chain CDR3 for antibody 12070 (IGKV6-21)
HQSSSLPYT

SEQ ID NO: 24140 - protein, 16 aa, Homo sapiens
  Heavy chain CDR3 for antibody 12070 (IGHV3-66)
AREVGAKDYYYYGMDV

SEQ ID NO: 24141 - protein, 10 aa, Homo sapiens
  Light chain CDR3 for antibody 12071 (IGKV1-39)
QQSYSTPMYT

SEQ ID NO: 24142 - protein, 11 aa, Homo sapiens
  Heavy chain CDR3 for antibody 12071 (IGHV3-74)
ARDRGNWGFDY

SEQ ID NO: 24143 - protein, 9 aa, Homo sapiens
  Light chain CDR3 for antibody 12072 (IGKV3-15)
QQYNNWPRT

SEQ ID NO: 24144 - protein, 18 aa, Homo sapiens
  Heavy chain CDR3 for antibody 12072 (IGHV3-33)
ARDRDRYGSGTYPDAIDI

SEQ ID NO: 24145 - protein, 9 aa, Homo sapiens
  Light chain CDR3 for antibody 12073 (IGKV3D-7)
QQDYSFPIT

SEQ ID NO: 24146 - protein, 13 aa, Homo sapiens
  Heavy chain CDR3 for antibody 12073 (IGHV4-39)
APFRVMVRGVLDY

SEQ ID NO: 24147 - protein, 10 aa, Homo sapiens
  Light chain CDR3 for antibody 12074 (IGKV3-15)
QQYNNWPPYT

SEQ ID NO: 24148 - protein, 10 aa, Homo sapiens
  Heavy chain CDR3 for antibody 12074 (IGHV3-33)
ARDGSGSQPI

SEQ ID NO: 24149 - protein, 9 aa, Homo sapiens
  Light chain CDR3 for antibody 12075 (IGKV1-17)
LQHNNYPLT

SEQ ID NO: 24150 - protein, 20 aa, Homo sapiens
  Heavy chain CDR3 for antibody 12075 (IGHV3-33)
ARDNDSSGYYDYYYYYGMDV

SEQ ID NO: 24151 - protein, 9 aa, Homo sapiens
  Light chain CDR3 for antibody 12076 (IGKV3D-20)
QQHGNSPLT

SEQ ID NO: 24152 - protein, 12 aa, Homo sapiens
  Heavy chain CDR3 for antibody 12076 (IGHV4-39)
ARHGSGSSYFDY

SEQ ID NO: 24153 - protein, 9 aa, Homo sapiens
  Light chain CDR3 for antibody 12077 (IGKV1D-16)
QQYNYWPLT

SEQ ID NO: 24154 - protein, 13 aa, Homo sapiens
  Heavy chain CDR3 for antibody 12077 (IGHV3-33)
ASGYSGYDWYFDL

SEQ ID NO: 24155 - protein, 9 aa, Homo sapiens
  Light chain CDR3 for antibody 12078 (IGKV5-2)
LQHDKFPYT

SEQ ID NO: 24156 - protein, 20 aa, Homo sapiens
  Heavy chain CDR3 for antibody 12078 (IGHV3-23)
AKDRMTTVTSYYYYSYGMDV

SEQ ID NO: 24157 - protein, 10 aa, Homo sapiens
  Light chain CDR3 for antibody 12079 (IGKV1-9)
QQLDSYPMYT

SEQ ID NO: 24158 - protein, 21 aa, Homo sapiens
  Heavy chain CDR3 for antibody 12079 (IGHV3-33)
ARDEYYEIVTGYGYYHYGMDV

SEQ ID NO: 24159 - protein, 9 aa, Homo sapiens
  Light chain CDR3 for antibody 12080 (IGKV1D-16)
QQYNSFPLT

SEQ ID NO: 24160 - protein, 17 aa, Homo sapiens
  Heavy chain CDR3 for antibody 12080 (IGHV3-33)
ARSPYDILTGYSYYFDY

SEQ ID NO: 24161 - protein, 10 aa, Homo sapiens
  Light chain CDR3 for antibody 12081 (IGKV3-11)
QQRSNWPMYT

SEQ ID NO: 24162 - protein, 13 aa, Homo sapiens
  Heavy chain CDR3 for antibody 12081 (IGHV3-23)
AREYFDWLLPLDY

SEQ ID NO: 24163 - protein, 9 aa, Homo sapiens
  Light chain CDR3 for antibody 12082 (IGKV1-6)
LQDYNYPRT

SEQ ID NO: 24164 - protein, 12 aa, Homo sapiens
  Heavy chain CDR3 for antibody 12082 (IGHV1-46)
ARGPTGDHALDI

SEQ ID NO: 24165 - protein, 9 aa, Homo sapiens
  Light chain CDR3 for antibody 12083 (IGKV1D-13)
QQFNNYPHT

SEQ ID NO: 24166 - protein, 10 aa, Homo sapiens
  Heavy chain CDR3 for antibody 12083 (IGHV1-18)
ARGPTSDVDY

SEQ ID NO: 24167 - protein, 9 aa, Homo sapiens
  Light chain CDR3 for antibody 12084 (IGKV1-16)
QQYSSYPYT

SEQ ID NO: 24168 - protein, 14 aa, Homo sapiens
  Heavy chain CDR3 for antibody 12084 (IGHV3-33)
AGQYSYGYPYYFDY

SEQ ID NO: 24169 - protein, 8 aa, Homo sapiens
  Light chain CDR3 for antibody 12085 (IGKV1D-13)
QQFNNYPT

SEQ ID NO: 24170 - protein, 17 aa, Homo sapiens
  Heavy chain CDR3 for antibody 12085 (IGHV3-33)
ARGGGYENDHYYYGMDV

SEQ ID NO: 24171 - protein, 9 aa, Homo sapiens
  Light chain CDR3 for antibody 12086 (IGKV3D-7)
QQDYSFPLT

SEQ ID NO: 24172 - protein, 20 aa, Homo sapiens
  Heavy chain CDR3 for antibody 12086 (IGHV3-23)
AKDREMAATSHYYYYYGMDV

SEQ ID NO: 24173 - protein, 6 aa, Homo sapiens
  Light chain CDR3 for antibody 12087 (IGKV3-20)
QQYGST

SEQ ID NO: 24174 - protein, 20 aa, Homo sapiens
  Heavy chain CDR3 for antibody 12087 (IGHV3-33)
ARDWMVRGVIITDYYYGMDV

SEQ ID NO: 24175 - protein, 10 aa, Homo sapiens
  Light chain CDR3 for antibody 12088 (IGKV3-11)
QQHSNWPIFT

SEQ ID NO: 24176 - protein, 18 aa, Homo sapiens
  Heavy chain CDR3 for antibody 12088 (IGHV3-33)
ARDYDSLTTYPEDYGMDV

SEQ ID NO: 24177 - protein, 9 aa, Homo sapiens
  Light chain CDR3 for antibody 12089 (IGKV3-20)
QQYGSSIFT

SEQ ID NO: 24178 - protein, 13 aa, Homo sapiens
  Heavy chain CDR3 for antibody 12089 (IGHV3-33)
ARAFIMVRGVIDY

SEQ ID NO: 24179 - protein, 9 aa, Homo sapiens
  Light chain CDR3 for antibody 12090 (IGKV1-16)
QHYNDYPFT

SEQ ID NO: 24180 - protein, 11 aa, Homo sapiens
  Heavy chain CDR3 for antibody 12090 (IGHV3-33)
ARAGIAALFDY

SEQ ID NO: 24181 - protein, 9 aa, Homo sapiens
  Light chain CDR3 for antibody 12091 (IGKV3D-7)
QQDYKLPLT

SEQ ID NO: 24182 - protein, 18 aa, Homo sapiens
  Heavy chain CDR3 for antibody 12091 (IGHV3-33)
ARREGITTIFYYYYGMDV

SEQ ID NO: 24183 - protein, 9 aa, Homo sapiens
  Light chain CDR3 for antibody 12092 (IGKV1-6)
LQDHNYPYT

SEQ ID NO: 24184 - protein, 20 aa, Homo sapiens
  Heavy chain CDR3 for antibody 12092 (IGHV3-33)
ARDRCSSTSCYGYYYYGMDV

SEQ ID NO: 24185 - protein, 9 aa, Homo sapiens
  Light chain CDR3 for antibody 12093 (IGKV1-37)
QRTSNAPYT

SEQ ID NO: 24186 - protein, 9 aa, Homo sapiens
  Heavy chain CDR3 for antibody 12093 (IGHV3-30)
ARDNWGFDY

SEQ ID NO: 24187 - protein, 9 aa, Homo sapiens
  Light chain CDR3 for antibody 12094 (IGKV6-21)
HQSSSLPYT

SEQ ID NO: 24188 - protein, 16 aa, Homo sapiens
  Heavy chain CDR3 for antibody 12094 (IGHV3-23)
ARNDILTASGYYGMDV

SEQ ID NO: 24189 - protein, 9 aa, Homo sapiens
  Light chain CDR3 for antibody 12095 (IGKV3D-20)
QQYGRSPRT

SEQ ID NO: 24190 - protein, 19 aa, Homo sapiens
  Heavy chain CDR3 for antibody 12095 (IGHV4-39)
ARQGDVLRYFDWLLGAFDI

SEQ ID NO: 24191 - protein, 9 aa, Homo sapiens
  Light chain CDR3 for antibody 12096 (IGKV1-9)
QQLNSYPWP

SEQ ID NO: 24192 - protein, 20 aa, Homo sapiens
  Heavy chain CDR3 for antibody 12096 (IGHV3-33)
SRGGATLVRGVIDYYYGMDV

SEQ ID NO: 24193 - protein, 10 aa, Homo sapiens
  Light chain CDR3 for antibody 12097 (IGKV3-11)
QQRSNWPMYT

SEQ ID NO: 24194 - protein, 15 aa, Homo sapiens
  Heavy chain CDR3 for antibody 12097 (IGHV3-23)
AKAGGRYFDWFPFDY

SEQ ID NO: 24195 - protein, 9 aa, Homo sapiens
  Light chain CDR3 for antibody 12098 (IGKV1D-13)
QRFNNYLYT

SEQ ID NO: 24196 - protein, 12 aa, Homo sapiens
  Heavy chain CDR3 for antibody 12098 (IGHV3-33)
AREEAVAEAFDI

SEQ ID NO: 24197 - protein, 9 aa, Homo sapiens
  Light chain CDR3 for antibody 12099 (IGKV3-11)
QQRSSWPPT

SEQ ID NO: 24198 - protein, 17 aa, Homo sapiens
  Heavy chain CDR3 for antibody 12099 (IGHV3-23)
SKERNWNDGYYYFGMDA

SEQ ID NO: 24199 - protein, 9 aa, Homo sapiens
  Light chain CDR3 for antibody 12100 (IGKV3D-7)
QQDYNFPLT

SEQ ID NO: 24200 - protein, 11 aa, Homo sapiens
  Heavy chain CDR3 for antibody 12100 (IGHV4-59)
AREMGHDIFDI

SEQ ID NO: 24201 - protein, 10 aa, Homo sapiens
  Light chain CDR3 for antibody 12101 (IGKV3-11)
QQRSNWPIWT

SEQ ID NO: 24202 - protein, 14 aa, Homo sapiens
  Heavy chain CDR3 for antibody 12101 (IGHV4-39)
ARQGGWYLYWYFDL

SEQ ID NO: 24203 - protein, 9 aa, Homo sapiens
  Light chain CDR3 for antibody 12102 (IGKV1-6)
QQEYNYPLT

SEQ ID NO: 24204 - protein, 15 aa, Homo sapiens
  Heavy chain CDR3 for antibody 12102 (IGHV3-20)
ARDRGSSGWRDWFDP

SEQ ID NO: 24205 - protein, 8 aa, Homo sapiens
  Light chain CDR3 for antibody 12103 (IGKV6-21)
HQSSSLPT

SEQ ID NO: 24206 - protein, 16 aa, Homo sapiens
  Heavy chain CDR3 for antibody 12103 (IGHV3-30)
ARDIAVAGHVYYGMDV

SEQ ID NO: 24207 - protein, 8 aa, Homo sapiens
  Light chain CDR3 for antibody 12104 (IGKV1-5)
QQYNSYWT

SEQ ID NO: 24208 - protein, 14 aa, Homo sapiens
  Heavy chain CDR3 for antibody 12104 (IGHV1-18)
ARDQPTVPSGYFDY

SEQ ID NO: 24209 - protein, 9 aa, Homo sapiens
  Light chain CDR3 for antibody 12105 (IGKV3-15)
QQYNDWPLT

SEQ ID NO: 24210 - protein, 15 aa, Homo sapiens
  Heavy chain CDR3 for antibody 12105 (IGHV3-33)
ARGYYYGSGSYPLDY

SEQ ID NO: 24211 - protein, 10 aa, Homo sapiens
  Light chain CDR3 for antibody 12106 (IGKV1-33)
QQYDNLPPYT

SEQ ID NO: 24212 - protein, 15 aa, Homo sapiens
  Heavy chain CDR3 for antibody 12106 (IGHV3-33)
ARDTGYSSSWNWFDP

SEQ ID NO: 24213 - protein, 8 aa, Homo sapiens
  Light chain CDR3 for antibody 12107 (IGKV1-5)
QQYHSYYT

SEQ ID NO: 24214 - protein, 17 aa, Homo sapiens
  Heavy chain CDR3 for antibody 12107 (IGHV4-34)
ARDGSGSYTHYYYGMDV

SEQ ID NO: 24215 - protein, 9 aa, Homo sapiens
  Light chain CDR3 for antibody 12108 (IGKV1-37)
QRTYNAPYT

SEQ ID NO: 24216 - protein, 13 aa, Homo sapiens
  Heavy chain CDR3 for antibody 12108 (IGHV4-34)
ASNFYYYYYGMDV

SEQ ID NO: 24217 - protein, 10 aa, Homo sapiens
  Light chain CDR3 for antibody 12109 (IGKV3-11)
QQRSNWPALT

SEQ ID NO: 24218 - protein, 14 aa, Homo sapiens
  Heavy chain CDR3 for antibody 12109 (IGHV3-23)
AKGGDILTGYYPDY

SEQ ID NO: 24219 - protein, 9 aa, Homo sapiens
  Light chain CDR3 for antibody 12110 (IGKV1-9)
QQLNSYPWP

SEQ ID NO: 24220 - protein, 12 aa, Homo sapiens
  Heavy chain CDR3 for antibody 12110 (IGHV3-33)
TRGYSSKSYFDY

SEQ ID NO: 24221 - protein, 9 aa, Homo sapiens
  Light chain CDR3 for antibody 12111 (IGKV3D-7)
QQDYNLPLT

SEQ ID NO: 24222 - protein, 10 aa, Homo sapiens
  Heavy chain CDR3 for antibody 12111 (IGHV3-72)
CRDREGFGDV

SEQ ID NO: 24223 - protein, 9 aa, Homo sapiens
  Light chain CDR3 for antibody 12112 (IGKV5-2)
LQHDNFPWT

SEQ ID NO: 24224 - protein, 19 aa, Homo sapiens
  Heavy chain CDR3 for antibody 12112 (IGHV3-33)
ARGVRLRFFAPYYYYGLDV

SEQ ID NO: 24225 - protein, 9 aa, Homo sapiens
  Light chain CDR3 for antibody 12113 (IGKV1-16)
QQYNSYPIT

SEQ ID NO: 24226 - protein, 13 aa, Homo sapiens
  Heavy chain CDR3 for antibody 12113 (IGHV3-33)
ARDYCGGDCYLDY

SEQ ID NO: 24227 - protein, 9 aa, Homo sapiens
  Light chain CDR3 for antibody 12114 (IGKV3-15)
QQYHNWPRT

SEQ ID NO: 24228 - protein, 11 aa, Homo sapiens
  Heavy chain CDR3 for antibody 12114 (IGHV3-23)
AKAGIVGCLDV

SEQ ID NO: 24229 - protein, 9 aa, Homo sapiens
  Light chain CDR3 for antibody 12115 (IGKV1-27)
QKYNSAPWT

SEQ ID NO: 24230 - protein, 13 aa, Homo sapiens
  Heavy chain CDR3 for antibody 12115 (IGHV1-46)
ARVKLGSLGAFDI

SEQ ID NO: 24231 - protein, 9 aa, Homo sapiens
  Light chain CDR3 for antibody 12116 (IGKV6-21)
HQSSSLPYT

SEQ ID NO: 24232 - protein, 15 aa, Homo sapiens
  Heavy chain CDR3 for antibody 12116 (IGHV5-51)
AIRYYSSGRYDAFDI

SEQ ID NO: 24233 - protein, 9 aa, Homo sapiens
  Light chain CDR3 for antibody 12117 (IGKV3-15)
QQYNDWPRT

SEQ ID NO: 24234 - protein, 15 aa, Homo sapiens
  Heavy chain CDR3 for antibody 12117 (IGHV3-33)
ARDRGSSGYDRYFDY

SEQ ID NO: 24235 - protein, 9 aa, Homo sapiens
  Light chain CDR3 for antibody 12118 (IGKV1-39)
QQSYSTPIT

SEQ ID NO: 24236 - protein, 15 aa, Homo sapiens
  Heavy chain CDR3 for antibody 12118 (IGHV1-18)
ARGYCSSSSYYYFDY

SEQ ID NO: 24237 - protein, 9 aa, Homo sapiens
  Light chain CDR3 for antibody 12119 (IGKV1-16)
QHYNDYPFT

SEQ ID NO: 24238 - protein, 20 aa, Homo sapiens
  Heavy chain CDR3 for antibody 12119 (IGHV3-11)
ARGGATLIRGLIDYYYGMDV

SEQ ID NO: 24239 - protein, 8 aa, Homo sapiens
  Light chain CDR3 for antibody 12120 (IGKV2D-28)
MQALQTPT

SEQ ID NO: 24240 - protein, 17 aa, Homo sapiens
  Heavy chain CDR3 for antibody 12120 (IGHV3-33)
ARGDGDILTGYYEWFDP

SEQ ID NO: 24241 - protein, 9 aa, Homo sapiens
  Light chain CDR3 for antibody 12121 (IGKV3-7)
QQDYTLPLT

SEQ ID NO: 24242 - protein, 12 aa, Homo sapiens
  Heavy chain CDR3 for antibody 12121 (IGHV3-33)
AKDPGWQQLAEY

SEQ ID NO: 24243 - protein, 8 aa, Homo sapiens
  Light chain CDR3 for antibody 12122 (IGKV1-5)
QQYNSYYT

SEQ ID NO: 24244 - protein, 15 aa, Homo sapiens
  Heavy chain CDR3 for antibody 12122 (IGHV1-18)
ARRSPNWGHYYGMDV

SEQ ID NO: 24245 - protein, 9 aa, Homo sapiens
  Light chain CDR3 for antibody 12123 (IGKV1-9)
QQLNTYPWT

SEQ ID NO: 24246 - protein, 18 aa, Homo sapiens
  Heavy chain CDR3 for antibody 12123 (IGHV6-1)
ARDQYSYGPYYYYYGMDV

SEQ ID NO: 24247 - protein, 9 aa, Homo sapiens
  Light chain CDR3 for antibody 12124 (IGKV1-17)
LQHNSYPYT

SEQ ID NO: 24248 - protein, 9 aa, Homo sapiens
  Heavy chain CDR3 for antibody 12124 (IGHV4-59)
ARDDGDFDY

SEQ ID NO: 24249 - protein, 9 aa, Homo sapiens
  Light chain CDR3 for antibody 12125 (IGKV2-30)
MQGTHWPLT

SEQ ID NO: 24250 - protein, 14 aa, Homo sapiens
  Heavy chain CDR3 for antibody 12125 (IGHV3-20)
ARDGGSSSFDWFDP

SEQ ID NO: 24251 - protein, 9 aa, Homo sapiens
  Light chain CDR3 for antibody 12126 (IGKV1-9)
QQLISYPLT

SEQ ID NO: 24252 - protein, 16 aa, Homo sapiens
  Heavy chain CDR3 for antibody 12126 (IGHV1-8)
AREGTMVRGVTYALDI

SEQ ID NO: 24253 - protein, 9 aa, Homo sapiens
  Light chain CDR3 for antibody 12127 (IGKV3-15)
QQYNNWPRT

SEQ ID NO: 24254 - protein, 17 aa, Homo sapiens
  Heavy chain CDR3 for antibody 12127 (IGHV3-23)
AKDRPVTTLYYYFGMDV

SEQ ID NO: 24255 - protein, 9 aa, Homo sapiens
  Light chain CDR3 for antibody 12128 (IGKV4-1)
QQYYTTPPT

SEQ ID NO: 24256 - protein, 9 aa, Homo sapiens
  Heavy chain CDR3 for antibody 12128 (IGHV3-13)
ARDHWYFDL

SEQ ID NO: 24257 - protein, 9 aa, Homo sapiens
  Light chain CDR3 for antibody 12129 (IGKV1-6)
LQDFHYPWT

SEQ ID NO: 24258 - protein, 17 aa, Homo sapiens
  Heavy chain CDR3 for antibody 12129 (IGHV4-39)
ARQGWYYGSGSSLLFDY

SEQ ID NO: 24259 - protein, 9 aa, Homo sapiens
  Light chain CDR3 for antibody 12130 (IGKV1D-13)
QQFNNYPHT

SEQ ID NO: 24260 - protein, 10 aa, Homo sapiens
  Heavy chain CDR3 for antibody 12130 (IGHV3-23)
AKSGSYSFDY

SEQ ID NO: 24261 - protein, 10 aa, Homo sapiens
  Light chain CDR3 for antibody 12131 (IGKV1-6)
LQDYNYPMYT

SEQ ID NO: 24262 - protein, 15 aa, Homo sapiens
  Heavy chain CDR3 for antibody 12131 (IGHV3-23)
AKDGGWNYYYYGMDV

SEQ ID NO: 24263 - protein, 9 aa, Homo sapiens
  Light chain CDR3 for antibody 12132 (IGKV1D-13)
QRFNNYLYT

SEQ ID NO: 24264 - protein, 14 aa, Homo sapiens
  Heavy chain CDR3 for antibody 12132 (IGHV3-33)
ARGGYSGYRYYFDY

SEQ ID NO: 24265 - protein, 9 aa, Homo sapiens
  Light chain CDR3 for antibody 12133 (IGKV6-21)
HQRSSSPHT

SEQ ID NO: 24266 - protein, 18 aa, Homo sapiens
  Heavy chain CDR3 for antibody 12133 (IGHV1-46)
ARDGDYVWGSYRSDWFDP

SEQ ID NO: 24267 - protein, 9 aa, Homo sapiens
  Light chain CDR3 for antibody 12134 (IGKV1-6)
LQGYSYPFT

SEQ ID NO: 24268 - protein, 13 aa, Homo sapiens
  Heavy chain CDR3 for antibody 12134 (IGHV3-11)
ARDGGAAAGTWDS

SEQ ID NO: 24269 - protein, 9 aa, Homo sapiens
  Light chain CDR3 for antibody 12135 (IGKV2D-28)
MQALQTPPT

SEQ ID NO: 24270 - protein, 18 aa, Homo sapiens
  Heavy chain CDR3 for antibody 12135 (IGHV3-33)
ARGGVLYDILTGFYGMDV

SEQ ID NO: 24271 - protein, 9 aa, Homo sapiens
  Light chain CDR3 for antibody 12136 (IGKV3-20)
QQYGSSPRT

SEQ ID NO: 24272 - protein, 15 aa, Homo sapiens
  Heavy chain CDR3 for antibody 12136 (IGHV3-33)
ARERYSSAWSSGMDV

SEQ ID NO: 24273 - protein, 11 aa, Homo sapiens
  Light chain CDR3 for antibody 12137 (IGKV3-11)
QQRSNWPPMYT

SEQ ID NO: 24274 - protein, 9 aa, Homo sapiens
  Heavy chain CDR3 for antibody 12137 (IGHV4-59)
AGGSWDFDY

SEQ ID NO: 24275 - protein, 8 aa, Homo sapiens
  Light chain CDR3 for antibody 12138 (IGKV3-11)
QQRSNWLT

SEQ ID NO: 24276 - protein, 11 aa, Homo sapiens
  Heavy chain CDR3 for antibody 12138 (IGHV4-59)
ARSLRYSFFDY

SEQ ID NO: 24277 - protein, 9 aa, Homo sapiens
  Light chain CDR3 for antibody 12139 (IGKV1-37)
QRTYNAPYT

SEQ ID NO: 24278 - protein, 13 aa, Homo sapiens
  Heavy chain CDR3 for antibody 12139 (IGHV3-11)
ARDGGAAAGTWDS

SEQ ID NO: 24279 - protein, 9 aa, Homo sapiens
  Light chain CDR3 for antibody 12140 (IGKV1-16)
QQYNSYPYT

SEQ ID NO: 24280 - protein, 18 aa, Homo sapiens
  Heavy chain CDR3 for antibody 12140 (IGHV1-46)
SRAGHYVWGSYRSDWFDP

SEQ ID NO: 24281 - protein, 8 aa, Homo sapiens
  Light chain CDR3 for antibody 12141 (IGKV3-15)
QQYNNWPT

SEQ ID NO: 24282 - protein, 12 aa, Homo sapiens
  Heavy chain CDR3 for antibody 12141 (IGHV3-33)
VRDRAAAPYFDL

SEQ ID NO: 24283 - protein, 11 aa, Homo sapiens
  Light chain CDR3 for antibody 12142 (IGKV3-11)
QQRSNWPSMYT

SEQ ID NO: 24284 - protein, 13 aa, Homo sapiens
  Heavy chain CDR3 for antibody 12142 (IGHV4-34)
ASNFYYYYYGMDV

SEQ ID NO: 24285 - protein, 9 aa, Homo sapiens
  Light chain CDR3 for antibody 12143 (IGKV5-2)
LQHDNFPWT

SEQ ID NO: 24286 - protein, 15 aa, Homo sapiens
  Heavy chain CDR3 for antibody 12143 (IGHV3-33)
ARRGGIAAAGYYFDY

SEQ ID NO: 24287 - protein, 9 aa, Homo sapiens
  Light chain CDR3 for antibody 12144 (IGKV3-15)
QQYNNWPRT

SEQ ID NO: 24288 - protein, 14 aa, Homo sapiens
  Heavy chain CDR3 for antibody 12144 (IGHV1-46)
ARAYYAFLTGALDI

SEQ ID NO: 24289 - protein, 9 aa, Homo sapiens
  Light chain CDR3 for antibody 12145 (IGKV1-33)
QQYDNLPFT

SEQ ID NO: 24290 - protein, 6 aa, Homo sapiens
  Heavy chain CDR3 for antibody 12145 (IGHV1-8)
AREGTY

SEQ ID NO: 24291 - protein, 9 aa, Homo sapiens
  Light chain CDR3 for antibody 12146 (IGKV1-17)
PQHNSYPYT

SEQ ID NO: 24292 - protein, 10 aa, Homo sapiens
  Heavy chain CDR3 for antibody 12146 (IGHV1-18)
ASSNWNDGPL

SEQ ID NO: 24293 - protein, 9 aa, Homo sapiens
  Light chain CDR3 for antibody 12147 (IGKV1D-16)
QQYYSYPRT

SEQ ID NO: 24294 - protein, 9 aa, Homo sapiens
  Heavy chain CDR3 for antibody 12147 (IGHV3-30)
ARDYFHFDY

SEQ ID NO: 24295 - protein, 9 aa, Homo sapiens
  Light chain CDR3 for antibody 12148 (IGKV1D-13)
QQFNNYPYT

SEQ ID NO: 24296 - protein, 22 aa, Homo sapiens
  Heavy chain CDR3 for antibody 12148 (IGHV3-11)
AREAYYDILTGYYTGYYYGMDV

SEQ ID NO: 24297 - protein, 10 aa, Homo sapiens
  Light chain CDR3 for antibody 12149 (IGKV1-39)
QQSYSTPMYT

SEQ ID NO: 24298 - protein, 12 aa, Homo sapiens
  Heavy chain CDR3 for antibody 12149 (IGHV3-33)
ARDSSGWSHFDY

SEQ ID NO: 24299 - protein, 9 aa, Homo sapiens
  Light chain CDR3 for antibody 12150 (IGKV3D-7)
QQDYNLPYT

SEQ ID NO: 24300 - protein, 10 aa, Homo sapiens
  Heavy chain CDR3 for antibody 12150 (IGHV3-30)
ARDGLESFDY

SEQ ID NO: 24301 - protein, 9 aa, Homo sapiens
  Light chain CDR3 for antibody 12151 (IGKV4-1)
QQYYSTPPT

SEQ ID NO: 24302 - protein, 17 aa, Homo sapiens
  Heavy chain CDR3 for antibody 12151 (IGHV3-33)
ARGEQWLGYYYYYGMDV

SEQ ID NO: 24303 - protein, 9 aa, Homo sapiens
  Light chain CDR3 for antibody 12152 (IGKV1D-16)
QQYNSYPYT

SEQ ID NO: 24304 - protein, 13 aa, Homo sapiens
  Heavy chain CDR3 for antibody 12152 (IGHV4-39)
ARRDGSYYGYFGY

SEQ ID NO: 24305 - protein, 9 aa, Homo sapiens
  Light chain CDR3 for antibody 12153 (IGKV3D-20)
QQYGYSPRT

SEQ ID NO: 24306 - protein, 16 aa, Homo sapiens
  Heavy chain CDR3 for antibody 12153 (IGHV3-33)
AKDAFYYGSGSHLFDY

SEQ ID NO: 24307 - protein, 9 aa, Homo sapiens
  Light chain CDR3 for antibody 12154 (IGKV1-9)
QQLHIYPWT

SEQ ID NO: 24308 - protein, 12 aa, Homo sapiens
  Heavy chain CDR3 for antibody 12154 (IGHV3-33)
ARESGGSYSFDY

SEQ ID NO: 24309 - protein, 9 aa, Homo sapiens
  Light chain CDR3 for antibody 12155 (IGKV1D-16)
QQYDSYPWT

SEQ ID NO: 24310 - protein, 14 aa, Homo sapiens
  Heavy chain CDR3 for antibody 12155 (IGHV4-39)
ARRGVLVPPGGMDV

SEQ ID NO: 24311 - protein, 9 aa, Homo sapiens
  Light chain CDR3 for antibody 12156 (IGKV1-6)
LQDYNYPRT

SEQ ID NO: 24312 - protein, 16 aa, Homo sapiens
  Heavy chain CDR3 for antibody 12156 (IGHV3-23)
AKEGIVLRYFDWFWDY

SEQ ID NO: 24313 - protein, 9 aa, Homo sapiens
  Light chain CDR3 for antibody 12157 (IGKV2D-24)
TQATQFPHT

SEQ ID NO: 24314 - protein, 18 aa, Homo sapiens
  Heavy chain CDR3 for antibody 12157 (IGHV3-33)
ARGYYGSGNFYKDSGMDV

SEQ ID NO: 24315 - protein, 9 aa, Homo sapiens
  Light chain CDR3 for antibody 12158 (IGKV3D-20)
QQYGYSPLT

SEQ ID NO: 24316 - protein, 22 aa, Homo sapiens
  Heavy chain CDR3 for antibody 12158 (IGHV3-23)
AKDDLPYYDILTHSTTTGGMDV

SEQ ID NO: 24317 - protein, 9 aa, Homo sapiens
  Light chain CDR3 for antibody 12159 (IGKV1-6)
QQYDSYPWT

SEQ ID NO: 24318 - protein, 16 aa, Homo sapiens
  Heavy chain CDR3 for antibody 12159 (IGHV3-23)
AKEGMVLRYFDWLWDY

SEQ ID NO: 24319 - protein, 9 aa, Homo sapiens
  Light chain CDR3 for antibody 12160 (IGKV2-30)
MQGTHWPLT

SEQ ID NO: 24320 - protein, 19 aa, Homo sapiens
  Heavy chain CDR3 for antibody 12160 (IGHV3-20)
ARDSAVAGRYYYYYYGMDV

SEQ ID NO: 24321 - protein, 9 aa, Homo sapiens
  Light chain CDR3 for antibody 12161 (IGKV1-39)
QQGFSTPWT

SEQ ID NO: 24322 - protein, 16 aa, Homo sapiens
  Heavy chain CDR3 for antibody 12161 (IGHV4-59)
ARDTPYYSGSGRPFDS

SEQ ID NO: 24323 - protein, 9 aa, Homo sapiens
  Light chain CDR3 for antibody 12162 (IGKV1-17)
LHSNNYPWT

SEQ ID NO: 24324 - protein, 11 aa, Homo sapiens
  Heavy chain CDR3 for antibody 12162 (IGHV3-33)
ARDKSSGWSDY

SEQ ID NO: 24325 - protein, 9 aa, Homo sapiens
  Light chain CDR3 for antibody 12163 (IGKV1-6)
QHYNDYPFT

SEQ ID NO: 24326 - protein, 20 aa, Homo sapiens
  Heavy chain CDR3 for antibody 12163 (IGHV1-f)
ATGLITFVRGVILTYRSFDY

SEQ ID NO: 24327 - protein, 9 aa, Homo sapiens
  Light chain CDR3 for antibody 12164 (IGKV1-16)
QHYNDYPFT

SEQ ID NO: 24328 - protein, 13 aa, Homo sapiens
  Heavy chain CDR3 for antibody 12164 (IGHV3-23)
ASPFNWNDGFFDY

SEQ ID NO: 24329 - protein, 9 aa, Homo sapiens
  Light chain CDR3 for antibody 12165 (IGKV5-2)
LQHDNFPYT

SEQ ID NO: 24330 - protein, 19 aa, Homo sapiens
  Heavy chain CDR3 for antibody 12165 (IGHV3-20)
ARDSAVAGRYYYYYYGMDV

SEQ ID NO: 24331 - protein, 9 aa, Homo sapiens
  Light chain CDR3 for antibody 12166 (IGKV1-16)
QQYNSYPYT

SEQ ID NO: 24332 - protein, 23 aa, Homo sapiens
  Heavy chain CDR3 for antibody 12166 (IGHV3-30)
ARDGDYFGSGSQRDYHYYYGLDV

SEQ ID NO: 24333 - protein, 10 aa, Homo sapiens
  Light chain CDR3 for antibody 12167 (IGKV3-11)
QQRSNWPIFT

SEQ ID NO: 24334 - protein, 14 aa, Homo sapiens
  Heavy chain CDR3 for antibody 12167 (IGHV3-33)
VSAISGSSYWYFAL

SEQ ID NO: 24335 - protein, 9 aa, Homo sapiens
  Light chain CDR3 for antibody 12168 (IGKV1D-16)
QQYNSYPRT

SEQ ID NO: 24336 - protein, 17 aa, Homo sapiens
  Heavy chain CDR3 for antibody 12168 (IGHV3-33)
AREKGLGIDYYYYGMDV

SEQ ID NO: 24337 - protein, 8 aa, Homo sapiens
  Light chain CDR3 for antibody 12169 (IGKV3-20)
QQYGSSRT

SEQ ID NO: 24338 - protein, 15 aa, Homo sapiens
  Heavy chain CDR3 for antibody 12169 (IGHV4-59)
ARDGHGNWGSGTFDY

SEQ ID NO: 24339 - protein, 9 aa, Homo sapiens
  Light chain CDR3 for antibody 12170 (IGKV3-15)
QQYHNWPLT

SEQ ID NO: 24340 - protein, 18 aa, Homo sapiens
  Heavy chain CDR3 for antibody 12170 (IGHV3-23)
ARYHLYFGSGFGSDGMDV

SEQ ID NO: 24341 - protein, 9 aa, Homo sapiens
  Light chain CDR3 for antibody 12171 (IGKV1-9)
QQLKSYLYT

SEQ ID NO: 24342 - protein, 15 aa, Homo sapiens
  Heavy chain CDR3 for antibody 12171 (IGHV4-59)
ARDLCHYYGSVSIDY

SEQ ID NO: 24343 - protein, 8 aa, Homo sapiens
  Light chain CDR3 for antibody 12172 (IGKV1-5)
QQYNSYWT

SEQ ID NO: 24344 - protein, 13 aa, Homo sapiens
  Heavy chain CDR3 for antibody 12172 (IGHV3-33)
ARALYSSSWPGDY

SEQ ID NO: 24345 - protein, 9 aa, Homo sapiens
  Light chain CDR3 for antibody 12173 (IGKV1-33)
QQYDNLPFT

SEQ ID NO: 24346 - protein, 12 aa, Homo sapiens
  Heavy chain CDR3 for antibody 12173 (IGHV4-59)
ARDSGSYYYFDY

SEQ ID NO: 24347 - protein, 9 aa, Homo sapiens
  Light chain CDR3 for antibody 12174 (IGKV3D-7)
QQDYNLPYT

SEQ ID NO: 24348 - protein, 12 aa, Homo sapiens
  Heavy chain CDR3 for antibody 12174 (IGHV3-33)
AREEAVAEAFDI

SEQ ID NO: 24349 - protein, 9 aa, Homo sapiens
  Light chain CDR3 for antibody 12175 (IGKV1-6)
LQDYKSPFT

SEQ ID NO: 24350 - protein, 15 aa, Homo sapiens
  Heavy chain CDR3 for antibody 12175 (IGHV3-33)
VCVLYDYGDYVGFDY

SEQ ID NO: 24351 - protein, 10 aa, Homo sapiens
  Light chain CDR3 for antibody 12176 (IGKV3-11)
QQRSNWPIFT

SEQ ID NO: 24352 - protein, 20 aa, Homo sapiens
  Heavy chain CDR3 for antibody 12176 (IGHV3-33)
AREDYYGSGSYYPAYNWFDP

SEQ ID NO: 24353 - protein, 10 aa, Homo sapiens
  Light chain CDR3 for antibody 12177 (IGKV1-39)
QQSYSTPMYT

SEQ ID NO: 24354 - protein, 12 aa, Homo sapiens
  Heavy chain CDR3 for antibody 12177 (IGHV3-33)
AKEGIVGVPFDY

SEQ ID NO: 24355 - protein, 9 aa, Homo sapiens
  Light chain CDR3 for antibody 12178 (IGKV1-33)
QQYDNLPFT

SEQ ID NO: 24356 - protein, 21 aa, Homo sapiens
  Heavy chain CDR3 for antibody 12178 (IGHV3-33)
ARDEYYEIVTGYGYYHYGMDV

SEQ ID NO: 24357 - protein, 9 aa, Homo sapiens
  Light chain CDR3 for antibody 12179 (IGKV1-9)
QQYYTYPYT

SEQ ID NO: 24358 - protein, 16 aa, Homo sapiens
  Heavy chain CDR3 for antibody 12179 (IGHV3-33)
ARGYDMLTGDYYGMDV

SEQ ID NO: 24359 - protein, 9 aa, Homo sapiens
  Light chain CDR3 for antibody 12180 (IGKV3-11)
QQRINWPWT

SEQ ID NO: 24360 - protein, 14 aa, Homo sapiens
  Heavy chain CDR3 for antibody 12180 (IGHV4-59)
ARDSGYDYYYGMDV

SEQ ID NO: 24361 - protein, 9 aa, Homo sapiens
  Light chain CDR3 for antibody 12181 (IGKV3-11)
QQRSNWPPT

SEQ ID NO: 24362 - protein, 18 aa, Homo sapiens
  Heavy chain CDR3 for antibody 12181 (IGHV3-33)
VREGGYYGSGSYPDAFDI

SEQ ID NO: 24363 - protein, 9 aa, Homo sapiens
  Light chain CDR3 for antibody 12182 (IGKV1-9)
QQLNSYPFT

SEQ ID NO: 24364 - protein, 18 aa, Homo sapiens
  Heavy chain CDR3 for antibody 12182 (IGHV1-46)
ARDLTGRTENYYYYGMDV

SEQ ID NO: 24365 - protein, 9 aa, Homo sapiens
  Light chain CDR3 for antibody 12183 (IGKV3-20)
QQCDSSIFT

SEQ ID NO: 24366 - protein, 11 aa, Homo sapiens
  Heavy chain CDR3 for antibody 12183 (IGHV3-33)
AREAANWGFDY

SEQ ID NO: 24367 - protein, 9 aa, Homo sapiens
  Light chain CDR3 for antibody 12184 (IGKV3-20)
QQFGRSPRT

SEQ ID NO: 24368 - protein, 20 aa, Homo sapiens
  Heavy chain CDR3 for antibody 12184 (IGHV1-18)
AREVGIAVAGTLYYYYGMDV

SEQ ID NO: 24369 - protein, 9 aa, Homo sapiens
  Light chain CDR3 for antibody 12185 (IGKV5-2)
LQHDNFPWT

SEQ ID NO: 24370 - protein, 13 aa, Homo sapiens
  Heavy chain CDR3 for antibody 12185 (IGHV3-33)
VRRIAVAGTEGDC

SEQ ID NO: 24371 - protein, 9 aa, Homo sapiens
  Light chain CDR3 for antibody 12186 (IGKV1D-16)
QQYDSYPPT

SEQ ID NO: 24372 - protein, 16 aa, Homo sapiens
  Heavy chain CDR3 for antibody 12186 (IGHV3-11)
ARDSELRYFDWFGMDV

SEQ ID NO: 24373 - protein, 9 aa, Homo sapiens
  Light chain CDR3 for antibody 12187 (IGKV6-21)
HQSSSLPHT

SEQ ID NO: 24374 - protein, 16 aa, Homo sapiens
  Heavy chain CDR3 for antibody 12187 (IGHV4-61)
ARDPRYSSGWYWYFDL

SEQ ID NO: 24375 - protein, 10 aa, Homo sapiens
  Light chain CDR3 for antibody 12188 (IGKV3-11)
QQRSNWPIFT

SEQ ID NO: 24376 - protein, 13 aa, Homo sapiens
  Heavy chain CDR3 for antibody 12188 (IGHV1-46)
ARVKLGSLGAFDI

SEQ ID NO: 24377 - protein, 9 aa, Homo sapiens
  Light chain CDR3 for antibody 12189 (IGKV1D-16)
QQYHSYPYT

SEQ ID NO: 24378 - protein, 12 aa, Homo sapiens
  Heavy chain CDR3 for antibody 12189 (IGHV1-46)
ATGLTGHHALDI

SEQ ID NO: 24379 - protein, 8 aa, Homo sapiens
  Light chain CDR3 for antibody 12190 (IGKV6-21)
HQSSSLPT

SEQ ID NO: 24380 - protein, 9 aa, Homo sapiens
  Heavy chain CDR3 for antibody 12190 (IGHV3-33)
AREYKEFDY

SEQ ID NO: 24381 - protein, 9 aa, Homo sapiens
  Light chain CDR3 for antibody 12191 (IGKV1-9)
QQLTSFPRT

SEQ ID NO: 24382 - protein, 15 aa, Homo sapiens
  Heavy chain CDR3 for antibody 12191 (IGHV3-33)
ARDHLTGYYYYGMDV

SEQ ID NO: 24383 - protein, 9 aa, Homo sapiens
  Light chain CDR3 for antibody 12192 (IGKV1-16)
QQEYNYPLT

SEQ ID NO: 24384 - protein, 18 aa, Homo sapiens
  Heavy chain CDR3 for antibody 12192 (IGHV1-18)
ARDPNYYGSGSYYNYFDY

SEQ ID NO: 24385 - protein, 9 aa, Homo sapiens
  Light chain CDR3 for antibody 12193 (IGKV1-33)
QQYDNLPFT

SEQ ID NO: 24386 - protein, 14 aa, Homo sapiens
  Heavy chain CDR3 for antibody 12193 (IGHV3-33)
ARDGYDFLTGPFDY

SEQ ID NO: 24387 - protein, 9 aa, Homo sapiens
  Light chain CDR3 for antibody 12194 (IGKV5-2)
LQHDNFPYT

SEQ ID NO: 24388 - protein, 12 aa, Homo sapiens
  Heavy chain CDR3 for antibody 12194 (IGHV3-33)
ARERGIGRYFDL

SEQ ID NO: 24389 - protein, 9 aa, Homo sapiens
  Light chain CDR3 for antibody 12195 (IGKV1-27)
QQFNNYMYT

SEQ ID NO: 24390 - protein, 13 aa, Homo sapiens
  Heavy chain CDR3 for antibody 12195 (IGHV3-23)
APPFNWNDGFFDY

SEQ ID NO: 24391 - protein, 9 aa, Homo sapiens
  Light chain CDR3 for antibody 12196 (IGKV1D-13)
QHFNNYMYT

SEQ ID NO: 24392 - protein, 17 aa, Homo sapiens
  Heavy chain CDR3 for antibody 12196 (IGHV3-23)
AKEYCSGGSCYVYYFDY

SEQ ID NO: 24393 - protein, 9 aa, Homo sapiens
  Light chain CDR3 for antibody 12197 (IGKV1-9)
QQLNTYPWT

SEQ ID NO: 24394 - protein, 13 aa, Homo sapiens
  Heavy chain CDR3 for antibody 12197 (IGHV3-33)
ASGYSGYDWYFDL

SEQ ID NO: 24395 - protein, 9 aa, Homo sapiens
  Light chain CDR3 for antibody 12198 (IGKV1-6)
LQDYNYPRT

SEQ ID NO: 24396 - protein, 12 aa, Homo sapiens
  Heavy chain CDR3 for antibody 12198 (IGHV1-46)
ARCLIGDHAVEI

SEQ ID NO: 24397 - protein, 11 aa, Homo sapiens
  Light chain CDR3 for antibody 12199 (IGKV5-2)
QQRSNWPPTWT

SEQ ID NO: 24398 - protein, 14 aa, Homo sapiens
  Heavy chain CDR3 for antibody 12199 (IGHV1-46)
ARDGVGAKEGGFDY

SEQ ID NO: 24399 - protein, 9 aa, Homo sapiens
  Light chain CDR3 for antibody 12200 (IGKV3D-7)
QQDYNLPYT

SEQ ID NO: 24400 - protein, 12 aa, Homo sapiens
  Heavy chain CDR3 for antibody 12200 (IGHV3-33)
ARVDAAAPYFDY

SEQ ID NO: 24401 - protein, 8 aa, Homo sapiens
  Light chain CDR3 for antibody 12201 (IGKV3-15)
QQYNNWPT

SEQ ID NO: 24402 - protein, 11 aa, Homo sapiens
  Heavy chain CDR3 for antibody 12201 (IGHV4-59)
ARDGSWEPFDY

SEQ ID NO: 24403 - protein, 9 aa, Homo sapiens
  Light chain CDR3 for antibody 12202 (IGKV1-9)
QQYHSYPYT

SEQ ID NO: 24404 - protein, 17 aa, Homo sapiens
  Heavy chain CDR3 for antibody 12202 (IGHV3-33)
ARESLKLGIYYYYGMDV

SEQ ID NO: 24405 - protein, 9 aa, Homo sapiens
  Light chain CDR3 for antibody 12203 (IGKV1-9)
QQLNSYPWP

SEQ ID NO: 24406 - protein, 14 aa, Homo sapiens
  Heavy chain CDR3 for antibody 12203 (IGHV3-33)
ARGGYSGYRYYFDY

SEQ ID NO: 24407 - protein, 9 aa, Homo sapiens
  Light chain CDR3 for antibody 12204 (IGKV1-6)
LQDYKSPFT

SEQ ID NO: 24408 - protein, 19 aa, Homo sapiens
  Heavy chain CDR3 for antibody 12204 (IGHV1-18)
ARDDILTGYSLYYYYGMDV

SEQ ID NO: 24409 - protein, 10 aa, Homo sapiens
  Light chain CDR3 for antibody 12205 (IGKV1-17)
LQHNSYPMYT

SEQ ID NO: 24410 - protein, 8 aa, Homo sapiens
  Heavy chain CDR3 for antibody 12205 (IGHV3-23)
AKESLLDY

SEQ ID NO: 24411 - protein, 9 aa, Homo sapiens
  Light chain CDR3 for antibody 12206 (IGKV1-9)
QQLNSYPYT

SEQ ID NO: 24412 - protein, 14 aa, Homo sapiens
  Heavy chain CDR3 for antibody 12206 (IGHV3-33)
ARQYSYGYPYYLDY

SEQ ID NO: 24413 - protein, 11 aa, Homo sapiens
  Light chain CDR3 for antibody 12207 (IGKV3-11)
QQRSNWPPTWT

SEQ ID NO: 24414 - protein, 18 aa, Homo sapiens
  Heavy chain CDR3 for antibody 12207 (IGHV3-33)
ARGGVLYDILTGFYGMDV

SEQ ID NO: 24415 - protein, 9 aa, Homo sapiens
  Light chain CDR3 for antibody 12208 (IGKV3-20)
QQYGSSPYT

SEQ ID NO: 24416 - protein, 16 aa, Homo sapiens
  Heavy chain CDR3 for antibody 12208 (IGHV3-33)
ARGRYFDWLLGDWFDP

SEQ ID NO: 24417 - protein, 9 aa, Homo sapiens
  Light chain CDR3 for antibody 12209 (IGKV1-17)
LQHYSYPRT

SEQ ID NO: 24418 - protein, 16 aa, Homo sapiens
  Heavy chain CDR3 for antibody 12209 (IGHV3-33)
VRDGSMVRRIHDAFDF

SEQ ID NO: 24419 - protein, 9 aa, Homo sapiens
  Light chain CDR3 for antibody 12210 (IGKV1-16)
QQYIRYPYT

SEQ ID NO: 24420 - protein, 14 aa, Homo sapiens
  Heavy chain CDR3 for antibody 12210 (IGHV1-46)
ARKGIVGAFDAFDI

SEQ ID NO: 24421 - protein, 9 aa, Homo sapiens
  Light chain CDR3 for antibody 12211 (IGKV6-21)
HQSSSLPYT

SEQ ID NO: 24422 - protein, 17 aa, Homo sapiens
  Heavy chain CDR3 for antibody 12211 (IGHV4-34)
ARDGSGSYTHYYYGMDV

SEQ ID NO: 24423 - protein, 9 aa, Homo sapiens
  Light chain CDR3 for antibody 12212 (IGKV1D-13)
QHFNNYMYT

SEQ ID NO: 24424 - protein, 18 aa, Homo sapiens
  Heavy chain CDR3 for antibody 12212 (IGHV3-33)
ARDYDSLTTYPEDYGMDV

SEQ ID NO: 24425 - protein, 9 aa, Homo sapiens
  Light chain CDR3 for antibody 12213 (IGKV1-33)
QQYDNLPFT

SEQ ID NO: 24426 - protein, 13 aa, Homo sapiens
  Heavy chain CDR3 for antibody 12213 (IGHV3-33)
ARVDTMVRGVMAY

SEQ ID NO: 24427 - protein, 10 aa, Homo sapiens
  Light chain CDR3 for antibody 12214 (IGKV1-39)
QQSYSTPMYT

SEQ ID NO: 24428 - protein, 13 aa, Homo sapiens
  Heavy chain CDR3 for antibody 12214 (IGHV3-23)
AKDRGYSSTSTAY

SEQ ID NO: 24429 - protein, 9 aa, Homo sapiens
  Light chain CDR3 for antibody 12215 (IGKV1-16)
QHYNDYPFT

SEQ ID NO: 24430 - protein, 14 aa, Homo sapiens
  Heavy chain CDR3 for antibody 12215 (IGHV3-33)
VRDARGATTAWFDP

SEQ ID NO: 24431 - protein, 10 aa, Homo sapiens
  Light chain CDR3 for antibody 12216 (IGKV3-20)
QQYGSSPPYT

SEQ ID NO: 24432 - protein, 19 aa, Homo sapiens
  Heavy chain CDR3 for antibody 12216 (IGHV1-18)
ARDDILTGYSLYYYYGMDV

SEQ ID NO: 24433 - protein, 10 aa, Homo sapiens
  Light chain CDR3 for antibody 12217 (IGKV3-11)
QQRSNWPIFT

SEQ ID NO: 24434 - protein, 11 aa, Homo sapiens
  Heavy chain CDR3 for antibody 12217 (IGHV4-59)
AREDYGVPFDY

SEQ ID NO: 24435 - protein, 9 aa, Homo sapiens
  Light chain CDR3 for antibody 12218 (IGKV1-17)
LQHNGYPLT

SEQ ID NO: 24436 - protein, 14 aa, Homo sapiens
  Heavy chain CDR3 for antibody 12218 (IGHV3-23)
AKSRIVGALYYFGY

SEQ ID NO: 24437 - protein, 8 aa, Homo sapiens
  Light chain CDR3 for antibody 12219 (IGKV3-20)
QQYGRSFT

SEQ ID NO: 24438 - protein, 11 aa, Homo sapiens
  Heavy chain CDR3 for antibody 12219 (IGHV4-59)
VRERGYYGMDV

SEQ ID NO: 24439 - protein, 8 aa, Homo sapiens
  Light chain CDR3 for antibody 12220 (IGKV1-5)
QQYNSYWT

SEQ ID NO: 24440 - protein, 10 aa, Homo sapiens
  Heavy chain CDR3 for antibody 12220 (IGHV3-30)
AREWYGGMDV

SEQ ID NO: 24441 - protein, 9 aa, Homo sapiens
  Light chain CDR3 for antibody 12221 (IGKV3D-20)
QQHGNSPLT

SEQ ID NO: 24442 - protein, 14 aa, Homo sapiens
  Heavy chain CDR3 for antibody 12221 (IGHV4-39)
ARQDYDILTGLFDY

SEQ ID NO: 24443 - protein, 8 aa, Homo sapiens
  Light chain CDR3 for antibody 12222 (IGKV6-21)
HQSSSLHT

SEQ ID NO: 24444 - protein, 12 aa, Homo sapiens
  Heavy chain CDR3 for antibody 12222 (IGHV3-33)
ARDIVATNYFDY

SEQ ID NO: 24445 - protein, 9 aa, Homo sapiens
  Light chain CDR3 for antibody 12223 (IGKV4-1)
QQYYSTPPT

SEQ ID NO: 24446 - protein, 12 aa, Homo sapiens
  Heavy chain CDR3 for antibody 12223 (IGHV3-33)
ARVDAAAPYFDY

SEQ ID NO: 24447 - protein, 9 aa, Homo sapiens
  Light chain CDR3 for antibody 12224 (IGKV5-2)
LQHDNFPYT

SEQ ID NO: 24448 - protein, 19 aa, Homo sapiens
  Heavy chain CDR3 for antibody 12224 (IGHV3-33)
ARGGVVRGVIEYYYYGMDV

SEQ ID NO: 24449 - protein, 6 aa, Homo sapiens
  Light chain CDR3 for antibody 12225 (IGKV3-20)
QQYGST

SEQ ID NO: 24450 - protein, 13 aa, Homo sapiens
  Heavy chain CDR3 for antibody 12225 (IGHV3-33)
ASTGDSYYYDMDV

SEQ ID NO: 24451 - protein, 9 aa, Homo sapiens
  Light chain CDR3 for antibody 12226 (IGKV1D-16)
QQYAGYPPT

SEQ ID NO: 24452 - protein, 11 aa, Homo sapiens
  Heavy chain CDR3 for antibody 12226 (IGHV4-59)
AREMGHDTFDI

SEQ ID NO: 24453 - protein, 10 aa, Homo sapiens
  Light chain CDR3 for antibody 12227 (IGKV1-39)
QQSYSTPMYT

SEQ ID NO: 24454 - protein, 24 aa, Homo sapiens
  Heavy chain CDR3 for antibody 12227 (IGHV3-20)
ARGRITMVRGVIINPLDYYNGMDV

SEQ ID NO: 24455 - protein, 10 aa, Homo sapiens
  Light chain CDR3 for antibody 12228 (IGKV1-6)
LQDYNYPMYT

SEQ ID NO: 24456 - protein, 18 aa, Homo sapiens
  Heavy chain CDR3 for antibody 12228 (IGHV4-59)
AREGDYVWGSYRPNWFDP

SEQ ID NO: 24457 - protein, 9 aa, Homo sapiens
  Light chain CDR3 for antibody 12229 (IGKV1-9)
QQLKSYPYT

SEQ ID NO: 24458 - protein, 10 aa, Homo sapiens
  Heavy chain CDR3 for antibody 12229 (IGHV3-23)
AKGDQWRFDP

SEQ ID NO: 24459 - protein, 9 aa, Homo sapiens
  Light chain CDR3 for antibody 12230 (IGKV1D-16)
QQYNSFPLT

SEQ ID NO: 24460 - protein, 19 aa, Homo sapiens
  Heavy chain CDR3 for antibody 12230 (IGHV3-33)
ARGARLRYFDPYYYYGMDV

SEQ ID NO: 24461 - protein, 9 aa, Homo sapiens
  Light chain CDR3 for antibody 12231 (IGKV4-1)
QQYYSTPWT

SEQ ID NO: 24462 - protein, 14 aa, Homo sapiens
  Heavy chain CDR3 for antibody 12231 (IGHV3-33)
ARQYSYGYPYYFDY

SEQ ID NO: 24463 - protein, 9 aa, Homo sapiens
  Light chain CDR3 for antibody 12232 (IGKV3D-7)
QQDYTLPLT

SEQ ID NO: 24464 - protein, 17 aa, Homo sapiens
  Heavy chain CDR3 for antibody 12232 (IGHV3-33)
ARDPARGNVRSFYGLDV

SEQ ID NO: 24465 - protein, 9 aa, Homo sapiens
  Light chain CDR3 for antibody 12233 (IGKV1-27)
QKYNSAPYT

SEQ ID NO: 24466 - protein, 15 aa, Homo sapiens
  Heavy chain CDR3 for antibody 12233 (IGHV3-64)
ARGGTGYYSYWYFDL

SEQ ID NO: 24467 - protein, 8 aa, Homo sapiens
  Light chain CDR3 for antibody 12234 (IGKV3-11)
LQRGNWPT

SEQ ID NO: 24468 - protein, 11 aa, Homo sapiens
  Heavy chain CDR3 for antibody 12234 (IGHV3-33)
ARDRVLTPFDY

SEQ ID NO: 24469 - protein, 9 aa, Homo sapiens
  Light chain CDR3 for antibody 12235 (IGKV1-9)
QQLISYPLT

SEQ ID NO: 24470 - protein, 14 aa, Homo sapiens
  Heavy chain CDR3 for antibody 12235 (IGHV3-33)
AKGGGVGAYNWFDP

SEQ ID NO: 24471 - protein, 9 aa, Homo sapiens
  Light chain CDR3 for antibody 12236 (IGKV3-11)
QQRSNWPYT

SEQ ID NO: 24472 - protein, 18 aa, Homo sapiens
  Heavy chain CDR3 for antibody 12236 (IGHV3-33)
ARGYNQGSGSYYNVCFDY

SEQ ID NO: 24473 - protein, 9 aa, Homo sapiens
  Light chain CDR3 for antibody 12237 (IGKV1D-16)
QQYNSYPRT

SEQ ID NO: 24474 - protein, 18 aa, Homo sapiens
  Heavy chain CDR3 for antibody 12237 (IGHV4-59)
AREGHYYTSGSYYKAFDY

SEQ ID NO: 24475 - protein, 9 aa, Homo sapiens
  Light chain CDR3 for antibody 12238 (IGKV3D-7)
QQDYELPIT

SEQ ID NO: 24476 - protein, 10 aa, Homo sapiens
  Heavy chain CDR3 for antibody 12238 (IGHV3-74)
ARENWGGFDY

SEQ ID NO: 24477 - protein, 8 aa, Homo sapiens
  Light chain CDR3 for antibody 12239 (IGKV3-11)
LQRGNWPT

SEQ ID NO: 24478 - protein, 11 aa, Homo sapiens
  Heavy chain CDR3 for antibody 12239 (IGHV4-59)
ARDGVRGVFDI

SEQ ID NO: 24479 - protein, 9 aa, Homo sapiens
  Light chain CDR3 for antibody 12240 (IGKV1D-16)
QQYNIYPFT

SEQ ID NO: 24480 - protein, 18 aa, Homo sapiens
  Heavy chain CDR3 for antibody 12240 (IGHV4-59)
AREGDYVWGSYRSNWFDP

SEQ ID NO: 24481 - protein, 9 aa, Homo sapiens
  Light chain CDR3 for antibody 12241 (IGKV1-39)
QQSYSSPFT

SEQ ID NO: 24482 - protein, 12 aa, Homo sapiens
  Heavy chain CDR3 for antibody 12241 (IGHV3-33)
ARESGGSYSFDY

SEQ ID NO: 24483 - protein, 9 aa, Homo sapiens
  Light chain CDR3 for antibody 12242 (IGKV3-15)
QQYNNWPYT

SEQ ID NO: 24484 - protein, 11 aa, Homo sapiens
  Heavy chain CDR3 for antibody 12242 (IGHV3-13)
ARQAIISPFDY

SEQ ID NO: 24485 - protein, 11 aa, Homo sapiens
  Light chain CDR3 for antibody 12243 (IGKV3-11)
QQRSNWPPMYT

SEQ ID NO: 24486 - protein, 20 aa, Homo sapiens
  Heavy chain CDR3 for antibody 12243 (IGHV1-f)
ATGLITFVRGVILTYRSFDY

SEQ ID NO: 24487 - protein, 9 aa, Homo sapiens
  Light chain CDR3 for antibody 12244 (IGKV1D-13)
QQFNNYPHT

SEQ ID NO: 24488 - protein, 19 aa, Homo sapiens
  Heavy chain CDR3 for antibody 12244 (IGHV3-23)
ARDKYYDILTGYPWNGMDV

SEQ ID NO: 24489 - protein, 10 aa, Homo sapiens
  Light chain CDR3 for antibody 12245 (IGKV3-11)
QQRSNWLMYT

SEQ ID NO: 24490 - protein, 12 aa, Homo sapiens
  Heavy chain CDR3 for antibody 12245 (IGHV3-33)
ARGYFGSGYAHF

SEQ ID NO: 24491 - protein, 9 aa, Homo sapiens
  Light chain CDR3 for antibody 12246 (IGKV1D-13)
QQFNNYPHT

SEQ ID NO: 24492 - protein, 15 aa, Homo sapiens
  Heavy chain CDR3 for antibody 12246 (IGHV3-33)
ARGYYYGSGSYPLDY

SEQ ID NO: 24493 - protein, 9 aa, Homo sapiens
  Light chain CDR3 for antibody 12247 (IGKV1-6)
LQDYNYPYT

SEQ ID NO: 24494 - protein, 14 aa, Homo sapiens
  Heavy chain CDR3 for antibody 12247 (IGHV3-33)
ARDGSGSYPLYFDY

SEQ ID NO: 24495 - protein, 9 aa, Homo sapiens
  Light chain CDR3 for antibody 12248 (IGKV3D-7)
QQDYTLPLT

SEQ ID NO: 24496 - protein, 16 aa, Homo sapiens
  Heavy chain CDR3 for antibody 12248 (IGHV4-39)
ARRVPYYDILTGYLDY

SEQ ID NO: 24497 - protein, 9 aa, Homo sapiens
  Light chain CDR3 for antibody 12249 (IGKV2-30)
MQGTHWPLT

SEQ ID NO: 24498 - protein, 14 aa, Homo sapiens
  Heavy chain CDR3 for antibody 12249 (IGHV3-33)
ARDGYDILTGPMDV

SEQ ID NO: 24499 - protein, 11 aa, Homo sapiens
  Light chain CDR3 for antibody 12250 (IGKV3-11)
QQRSNWPPTWT

SEQ ID NO: 24500 - protein, 17 aa, Homo sapiens
  Heavy chain CDR3 for antibody 12250 (IGHV3-66)
ARVQYDILTGYSPYFDN

SEQ ID NO: 24501 - protein, 8 aa, Homo sapiens
  Light chain CDR3 for antibody 12251 (IGKV1-5)
QQYNSYYT

SEQ ID NO: 24502 - protein, 13 aa, Homo sapiens
  Heavy chain CDR3 for antibody 12251 (IGHV4-59)
ARTMVRGVAPFDY

SEQ ID NO: 24503 - protein, 9 aa, Homo sapiens
  Light chain CDR3 for antibody 12252 (IGKV1-9)
QQLNNYLFT

SEQ ID NO: 24504 - protein, 11 aa, Homo sapiens
  Heavy chain CDR3 for antibody 12252 (IGHV4-59)
ARSLRYSVFDY

SEQ ID NO: 24505 - protein, 9 aa, Homo sapiens
  Light chain CDR3 for antibody 12253 (IGKV1-9)
QQLHSYPYT

SEQ ID NO: 24506 - protein, 15 aa, Homo sapiens
  Heavy chain CDR3 for antibody 12253 (IGHV3-53)
ARDSHHDLLTGHYEY

SEQ ID NO: 24507 - protein, 9 aa, Homo sapiens
  Light chain CDR3 for antibody 12254 (IGKV3-20)
LQYGSSPYT

SEQ ID NO: 24508 - protein, 18 aa, Homo sapiens
  Heavy chain CDR3 for antibody 12254 (IGHV3-23)
AKPDYYGSGSYYNVPFDY

SEQ ID NO: 24509 - protein, 8 aa, Homo sapiens
  Light chain CDR3 for antibody 12255 (IGKV3-20)
QQYGSSFT

SEQ ID NO: 24510 - protein, 9 aa, Homo sapiens
  Heavy chain CDR3 for antibody 12255 (IGHV1-18)
ARGKDWFDP

SEQ ID NO: 24511 - protein, 9 aa, Homo sapiens
  Light chain CDR3 for antibody 12256 (IGKV5-2)
LQHDNFPYT

SEQ ID NO: 24512 - protein, 17 aa, Homo sapiens
  Heavy chain CDR3 for antibody 12256 (IGHV3-23)
AKDRDWNDGQYYFGMDV

SEQ ID NO: 24513 - protein, 8 aa, Homo sapiens
  Light chain CDR3 for antibody 12257 (IGKV1-17)
QQYNSYWT

SEQ ID NO: 24514 - protein, 14 aa, Homo sapiens
  Heavy chain CDR3 for antibody 12257 (IGHV3-33)
ARKGYSGRYYYFDY

SEQ ID NO: 24515 - protein, 9 aa, Homo sapiens
  Light chain CDR3 for antibody 12258 (IGKV3D-20)
QQFGSLPLT

SEQ ID NO: 24516 - protein, 13 aa, Homo sapiens
  Heavy chain CDR3 for antibody 12258 (IGHV4-39)
ARREVVGGRGFDY

SEQ ID NO: 24517 - protein, 9 aa, Homo sapiens
  Light chain CDR3 for antibody 12259 (IGKV1-17)
LQHNSYPYT

SEQ ID NO: 24518 - protein, 14 aa, Homo sapiens
  Heavy chain CDR3 for antibody 12259 (IGHV3-15)
SIYFYGSGRDYFDY

SEQ ID NO: 24519 - protein, 8 aa, Homo sapiens
  Light chain CDR3 for antibody 12260 (IGKV2D-28)
MQALQTPT

SEQ ID NO: 24520 - protein, 17 aa, Homo sapiens
  Heavy chain CDR3 for antibody 12260 (IGHV1-18)
ARDRAFTMVRGVPPFDY

SEQ ID NO: 24521 - protein, 9 aa, Homo sapiens
  Light chain CDR3 for antibody 12261 (IGKV1-9)
QQLNSYPLT

SEQ ID NO: 24522 - protein, 17 aa, Homo sapiens
  Heavy chain CDR3 for antibody 12261 (IGHV4-34)
ARDGSGSYTSYYYGMDV

SEQ ID NO: 24523 - protein, 9 aa, Homo sapiens
  Light chain CDR3 for antibody 12262 (IGKV3-11)
QQRSNWPPT

SEQ ID NO: 24524 - protein, 16 aa, Homo sapiens
  Heavy chain CDR3 for antibody 12262 (IGHV3-33)
ARDQGILTGYYTALDY

SEQ ID NO: 24525 - protein, 9 aa, Homo sapiens
  Light chain CDR3 for antibody 12263 (IGKV2-30)
MQGTHWPLT

SEQ ID NO: 24526 - protein, 17 aa, Homo sapiens
  Heavy chain CDR3 for antibody 12263 (IGHV3-33)
ARGGGYENDHYYYGMDV

SEQ ID NO: 24527 - protein, 9 aa, Homo sapiens
  Light chain CDR3 for antibody 12264 (IGKV6-21)
HQSTSLPFT

SEQ ID NO: 24528 - protein, 12 aa, Homo sapiens
  Heavy chain CDR3 for antibody 12264 (IGHV4-59)
ARDRIGWAYFDY

SEQ ID NO: 24529 - protein, 9 aa, Homo sapiens
  Light chain CDR3 for antibody 12265 (IGKV1-9)
QQLNSYPWP

SEQ ID NO: 24530 - protein, 18 aa, Homo sapiens
  Heavy chain CDR3 for antibody 12265 (IGHV3-33)
ARERGYYGSDIYPAAFDI

SEQ ID NO: 24531 - protein, 9 aa, Homo sapiens
  Light chain CDR3 for antibody 12266 (IGKV1-17)
LQHYSYPRT

SEQ ID NO: 24532 - protein, 11 aa, Homo sapiens
  Heavy chain CDR3 for antibody 12266 (IGHV3-33)
ARAGIAAVFDY

SEQ ID NO: 24533 - protein, 9 aa, Homo sapiens
  Light chain CDR3 for antibody 12267 (IGKV3-20)
QQYGSSPRT

SEQ ID NO: 24534 - protein, 16 aa, Homo sapiens
  Heavy chain CDR3 for antibody 12267 (IGHV1-24)
ATEDISSYYDYYGMDV

SEQ ID NO: 24535 - protein, 11 aa, Homo sapiens
  Light chain CDR3 for antibody 12268 (IGKV3-11)
QQRSNWPPTWT

SEQ ID NO: 24536 - protein, 9 aa, Homo sapiens
  Heavy chain CDR3 for antibody 12268 (IGHV3-33)
ARATVGVDY

SEQ ID NO: 24537 - protein, 9 aa, Homo sapiens
  Light chain CDR3 for antibody 12269 (IGKV5-2)
LQHDNFPYT

SEQ ID NO: 24538 - protein, 13 aa, Homo sapiens
  Heavy chain CDR3 for antibody 12269 (IGHV3-33)
ARTDYYYYYGMDV

SEQ ID NO: 24539 - protein, 8 aa, Homo sapiens
  Light chain CDR3 for antibody 12270 (IGKV1D-13)
QQFNTYPT

SEQ ID NO: 24540 - protein, 9 aa, Homo sapiens
  Heavy chain CDR3 for antibody 12270 (IGHV3-33)
ARATVGVDY

SEQ ID NO: 24541 - protein, 9 aa, Homo sapiens
  Light chain CDR3 for antibody 12271 (IGKV1-9)
QQLISYPLT

SEQ ID NO: 24542 - protein, 18 aa, Homo sapiens
  Heavy chain CDR3 for antibody 12271 (IGHV3-23)
AKEGDYYGSGSYWGYFDP

SEQ ID NO: 24543 - protein, 9 aa, Homo sapiens
  Light chain CDR3 for antibody 12272 (IGKV1-6)
LQDYNYPYT

SEQ ID NO: 24544 - protein, 16 aa, Homo sapiens
  Heavy chain CDR3 for antibody 12272 (IGHV4-59)
ARYSGCCYGDDYGMDV

SEQ ID NO: 24545 - protein, 9 aa, Homo sapiens
  Light chain CDR3 for antibody 12273 (IGKV1-16)
QQYNSYPYT

SEQ ID NO: 24546 - protein, 7 aa, Homo sapiens
  Heavy chain CDR3 for antibody 12273 (IGHV3-33)
ARDLVDY

SEQ ID NO: 24547 - protein, 9 aa, Homo sapiens
  Light chain CDR3 for antibody 12274 (IGKV1-6)
LQDYNYPWT

SEQ ID NO: 24548 - protein, 13 aa, Homo sapiens
  Heavy chain CDR3 for antibody 12274 (IGHV4-39)
AKHEVMIRGVFDY

SEQ ID NO: 24549 - protein, 9 aa, Homo sapiens
  Light chain CDR3 for antibody 12275 (IGKV2-30)
MQGTHWPLT

SEQ ID NO: 24550 - protein, 14 aa, Homo sapiens
  Heavy chain CDR3 for antibody 12275 (IGHV3-33)
ARDAYDILTGYYDY

SEQ ID NO: 24551 - protein, 9 aa, Homo sapiens
  Light chain CDR3 for antibody 12276 (IGKV5-2)
LQHDNFPYT

SEQ ID NO: 24552 - protein, 13 aa, Homo sapiens
  Heavy chain CDR3 for antibody 12276 (IGHV4-59)
ARGYYDIFGWFDP

SEQ ID NO: 24553 - protein, 8 aa, Homo sapiens
  Light chain CDR3 for antibody 12277 (IGKV1D-13)
QQFNNYHT

SEQ ID NO: 24554 - protein, 9 aa, Homo sapiens
  Heavy chain CDR3 for antibody 12277 (IGHV4-59)
AREGGSGSL

SEQ ID NO: 24555 - protein, 9 aa, Homo sapiens
  Light chain CDR3 for antibody 12278 (IGKV1-39)
QQSYSTPLT

SEQ ID NO: 24556 - protein, 16 aa, Homo sapiens
  Heavy chain CDR3 for antibody 12278 (IGHV3-23)
AKDGIGELSYYYGMDV

SEQ ID NO: 24557 - protein, 10 aa, Homo sapiens
  Light chain CDR3 for antibody 12279 (IGKV1-9)
QQLDSYPMYT

SEQ ID NO: 24558 - protein, 16 aa, Homo sapiens
  Heavy chain CDR3 for antibody 12279 (IGHV4-59)
ARGRYFEWLLGDVFDI

SEQ ID NO: 24559 - protein, 9 aa, Homo sapiens
  Light chain CDR3 for antibody 12280 (IGKV3-11)
QQRSNWPYT

SEQ ID NO: 24560 - protein, 13 aa, Homo sapiens
  Heavy chain CDR3 for antibody 12280 (IGHV3-74)
AKRYSSGWYPFDF

SEQ ID NO: 24561 - protein, 10 aa, Homo sapiens
  Light chain CDR3 for antibody 12281 (IGKV3-11)
QQRSNWPIYT

SEQ ID NO: 24562 - protein, 15 aa, Homo sapiens
  Heavy chain CDR3 for antibody 12281 (IGHV3-23)
AKDRSGSGSYNLFDY

SEQ ID NO: 24563 - protein, 9 aa, Homo sapiens
  Light chain CDR3 for antibody 12282 (IGKV1-6)
LQDYSYPWT

SEQ ID NO: 24564 - protein, 10 aa, Homo sapiens
  Heavy chain CDR3 for antibody 12282 (IGHV3-23)
AKEQWLVLDY

SEQ ID NO: 24565 - protein, 9 aa, Homo sapiens
  Light chain CDR3 for antibody 12283 (IGKV6-21)
HQSYSLPHT

SEQ ID NO: 24566 - protein, 9 aa, Homo sapiens
  Heavy chain CDR3 for antibody 12283 (IGHV3-21)
ARGSGWSDY

SEQ ID NO: 24567 - protein, 10 aa, Homo sapiens
  Light chain CDR3 for antibody 12284 (IGKV1-39)
QQSYSTPMYT

SEQ ID NO: 24568 - protein, 14 aa, Homo sapiens
  Heavy chain CDR3 for antibody 12284 (IGHV1-46)
ARAYYAFLTGALDI

SEQ ID NO: 24569 - protein, 8 aa, Homo sapiens
  Light chain CDR3 for antibody 12285 (IGKV3-11)
QQRSNWLT

SEQ ID NO: 24570 - protein, 15 aa, Homo sapiens
  Heavy chain CDR3 for antibody 12285 (IGHV1-8)
ARDRGWKAPGYGMDV

SEQ ID NO: 24571 - protein, 10 aa, Homo sapiens
  Light chain CDR3 for antibody 12286 (IGKV3-15)
QQYNNWPPYT

SEQ ID NO: 24572 - protein, 15 aa, Homo sapiens
  Heavy chain CDR3 for antibody 12286 (IGHV3-33)
AKDRNSGYDWGGFDY

SEQ ID NO: 24573 - protein, 9 aa, Homo sapiens
  Light chain CDR3 for antibody 12287 (IGKV3-15)
QQYNNWPRT

SEQ ID NO: 24574 - protein, 11 aa, Homo sapiens
  Heavy chain CDR3 for antibody 12287 (IGHV3-33)
ARDRATATVDY

SEQ ID NO: 24575 - protein, 9 aa, Homo sapiens
  Light chain CDR3 for antibody 12288 (IGKV6-21)
HQSSSLPYT

SEQ ID NO: 24576 - protein, 15 aa, Homo sapiens
  Heavy chain CDR3 for antibody 12288 (IGHV3-23)
AKDGSYSYYYYGMDA

SEQ ID NO: 24577 - protein, 9 aa, Homo sapiens
  Light chain CDR3 for antibody 12289 (IGKV1D-16)
QQYSSYPYT

SEQ ID NO: 24578 - protein, 18 aa, Homo sapiens
  Heavy chain CDR3 for antibody 12289 (IGHV3-33)
ARGLLWCGVSYYYYGMDV

SEQ ID NO: 24579 - protein, 10 aa, Homo sapiens
  Light chain CDR3 for antibody 12290 (IGKV1-9)
QQLDSYPMYT

SEQ ID NO: 24580 - protein, 19 aa, Homo sapiens
  Heavy chain CDR3 for antibody 12290 (IGHV3-33)
AREDYYGSGSYYNEDWFDP

SEQ ID NO: 24581 - protein, 9 aa, Homo sapiens
  Light chain CDR3 for antibody 12291 (IGKV1-39)
QQGFSTPWT

SEQ ID NO: 24582 - protein, 18 aa, Homo sapiens
  Heavy chain CDR3 for antibody 12291 (IGHV1-46)
ARDLTGRTENYYYYGMDV

SEQ ID NO: 24583 - protein, 9 aa, Homo sapiens
  Light chain CDR3 for antibody 12292 (IGKV6-21)
HQSSSLPLT

SEQ ID NO: 24584 - protein, 12 aa, Homo sapiens
  Heavy chain CDR3 for antibody 12292 (IGHV3-33)
ARERGIGRYFDL

SEQ ID NO: 24585 - protein, 8 aa, Homo sapiens
  Light chain CDR3 for antibody 12293 (IGKV1-5)
QQYNSYWT

SEQ ID NO: 24586 - protein, 12 aa, Homo sapiens
  Heavy chain CDR3 for antibody 12293 (IGHV3-33)
ARKGYDMHEFDI

SEQ ID NO: 24587 - protein, 9 aa, Homo sapiens
  Light chain CDR3 for antibody 12294 (IGKV1-9)
QQLKSYLYT

SEQ ID NO: 24588 - protein, 13 aa, Homo sapiens
  Heavy chain CDR3 for antibody 12294 (IGHV3-53)
ARSGSYWGYYFDY

SEQ ID NO: 24589 - protein, 9 aa, Homo sapiens
  Light chain CDR3 for antibody 12295 (IGKV1-9)
QQLNSYPRT

SEQ ID NO: 24590 - protein, 17 aa, Homo sapiens
  Heavy chain CDR3 for antibody 12295 (IGHV1-8)
ARGDYYGSGIYKYAMDV

SEQ ID NO: 24591 - protein, 8 aa, Homo sapiens
  Light chain CDR3 for antibody 12296 (IGKV2D-28)
MQALQTPT

SEQ ID NO: 24592 - protein, 13 aa, Homo sapiens
  Heavy chain CDR3 for antibody 12296 (IGHV3-33)
ARDYCGGDCYLDY

SEQ ID NO: 24593 - protein, 9 aa, Homo sapiens
  Light chain CDR3 for antibody 12297 (IGKV1-6)
LQDYKSPFT

SEQ ID NO: 24594 - protein, 17 aa, Homo sapiens
  Heavy chain CDR3 for antibody 12297 (IGHV3-64)
ARERYYGSGSYYNCFDP

SEQ ID NO: 24595 - protein, 9 aa, Homo sapiens
  Light chain CDR3 for antibody 12298 (IGKV2D-28)
MQALQTPPT

SEQ ID NO: 24596 - protein, 11 aa, Homo sapiens
  Heavy chain CDR3 for antibody 12298 (IGHV3-23)
AKGLWSYYFDY

SEQ ID NO: 24597 - protein, 9 aa, Homo sapiens
  Light chain CDR3 for antibody 12299 (IGKV3D-20)
QQHGNSPLT

SEQ ID NO: 24598 - protein, 17 aa, Homo sapiens
  Heavy chain CDR3 for antibody 12299 (IGHV4-39)
ARVLRYFDWLSHDAFDI

SEQ ID NO: 24599 - protein, 9 aa, Homo sapiens
  Light chain CDR3 for antibody 12300 (IGKV1D-13)
QRFNNYLYT

SEQ ID NO: 24600 - protein, 8 aa, Homo sapiens
  Heavy chain CDR3 for antibody 12300 (IGHV3-23)
AKESLLDY

SEQ ID NO: 24601 - protein, 9 aa, Homo sapiens
  Light chain CDR3 for antibody 12301 (IGKV1-6)
LQDYNYPRT

SEQ ID NO: 24602 - protein, 23 aa, Homo sapiens
  Heavy chain CDR3 for antibody 12301 (IGHV4-59)
ARERTYSGILPGYYEAYYYWMDV

SEQ ID NO: 24603 - protein, 10 aa, Homo sapiens
  Light chain CDR3 for antibody 12302 (IGKV3-11)
QQRSNWPPGT

SEQ ID NO: 24604 - protein, 16 aa, Homo sapiens
  Heavy chain CDR3 for antibody 12302 (IGHV4-59)
ARGRYFDWLLGDVFDI

SEQ ID NO: 24605 - protein, 9 aa, Homo sapiens
  Light chain CDR3 for antibody 12303 (IGKV1-9)
QQLNGYPFT

SEQ ID NO: 24606 - protein, 17 aa, Homo sapiens
  Heavy chain CDR3 for antibody 12303 (IGHV3-33)
ARVYYDILTGYSPAFDI

SEQ ID NO: 24607 - protein, 9 aa, Homo sapiens
  Light chain CDR3 for antibody 12304 (IGKV1D-16)
QQYITYPYT

SEQ ID NO: 24608 - protein, 18 aa, Homo sapiens
  Heavy chain CDR3 for antibody 12304 (IGHV3-33)
ARDRDRYGSGTYPDAIDI

SEQ ID NO: 24609 - protein, 9 aa, Homo sapiens
  Light chain CDR3 for antibody 12305 (IGKV3D-7)
QQDYTLPRT

SEQ ID NO: 24610 - protein, 26 aa, Homo sapiens
  Heavy chain CDR3 for antibody 12305 (IGHV4-39)
ARQGLLWFGDLKAYDSSGYYYGYFHH

SEQ ID NO: 24611 - protein, 9 aa, Homo sapiens
  Light chain CDR3 for antibody 12306 (IGKV3-15)
QQYNNWPYT

SEQ ID NO: 24612 - protein, 16 aa, Homo sapiens
  Heavy chain CDR3 for antibody 12306 (IGHV3-33)
ARGANYYGSGIPNFEY

SEQ ID NO: 24613 - protein, 9 aa, Homo sapiens
  Light chain CDR3 for antibody 12307 (IGKV3-15)
QQYNNWPYT

SEQ ID NO: 24614 - protein, 12 aa, Homo sapiens
  Heavy chain CDR3 for antibody 12307 (IGHV3-23)
AKEGLGSDYESC

SEQ ID NO: 24615 - protein, 8 aa, Homo sapiens
  Light chain CDR3 for antibody 12308 (IGKV1-9)
QQFNNYPT

SEQ ID NO: 24616 - protein, 13 aa, Homo sapiens
  Heavy chain CDR3 for antibody 12308 (IGHV4-28)
ARKGATGYYGMDV

SEQ ID NO: 24617 - protein, 9 aa, Homo sapiens
  Light chain CDR3 for antibody 12309 (IGKV1-6)
QHFNNYMYT

SEQ ID NO: 24618 - protein, 13 aa, Homo sapiens
  Heavy chain CDR3 for antibody 12309 (IGHV1-18)
ARSYYGSGSPFDY

SEQ ID NO: 24619 - protein, 9 aa, Homo sapiens
  Light chain CDR3 for antibody 12310 (IGKV6-21)
HQSSSLPYT

SEQ ID NO: 24620 - protein, 16 aa, Homo sapiens
  Heavy chain CDR3 for antibody 12310 (IGHV1-46)
ARGGGYSESYSNWFDP

SEQ ID NO: 24621 - protein, 9 aa, Homo sapiens
  Light chain CDR3 for antibody 12311 (IGKV3D-7)
QQDYNLPYT

SEQ ID NO: 24622 - protein, 18 aa, Homo sapiens
  Heavy chain CDR3 for antibody 12311 (IGHV3-33)
ARDGRISLVRGIIDAFDI

SEQ ID NO: 24623 - protein, 9 aa, Homo sapiens
  Light chain CDR3 for antibody 12312 (IGKV1-17)
LQHNSYPLT

SEQ ID NO: 24624 - protein, 14 aa, Homo sapiens
  Heavy chain CDR3 for antibody 12312 (IGHV3-33)
ARTTAAAGPRDFHH

SEQ ID NO: 24625 - protein, 9 aa, Homo sapiens
  Light chain CDR3 for antibody 12313 (IGKV1-37)
QRTYNAPFT

SEQ ID NO: 24626 - protein, 12 aa, Homo sapiens
  Heavy chain CDR3 for antibody 12313 (IGHV1-46)
ARGLIGDHAVDI

SEQ ID NO: 24627 - protein, 9 aa, Homo sapiens
  Light chain CDR3 for antibody 12314 (IGKV1-17)
LQHNSYPYT

SEQ ID NO: 24628 - protein, 14 aa, Homo sapiens
  Heavy chain CDR3 for antibody 12314 (IGHV3-33)
ARDDILTGYSYFQH

SEQ ID NO: 24629 - protein, 8 aa, Homo sapiens
  Light chain CDR3 for antibody 12315 (IGKV1-5)
QQYNSYWT

SEQ ID NO: 24630 - protein, 11 aa, Homo sapiens
  Heavy chain CDR3 for antibody 12315 (IGHV3-33)
ARGSGSYAFDS

SEQ ID NO: 24631 - protein, 9 aa, Homo sapiens
  Light chain CDR3 for antibody 12316 (IGKV3D-7)
QQDYNLPWT

SEQ ID NO: 24632 - protein, 17 aa, Homo sapiens
  Heavy chain CDR3 for antibody 12316 (IGHV3-33)
ARKDYGILSGYYSPFDY

SEQ ID NO: 24633 - protein, 9 aa, Homo sapiens
  Light chain CDR3 for antibody 12317 (IGKV3D-20)
QQYGSSPYT

SEQ ID NO: 24634 - protein, 17 aa, Homo sapiens
  Heavy chain CDR3 for antibody 12317 (IGHV3-33)
ARDRDDILTGFYTYFDY

SEQ ID NO: 24635 - protein, 10 aa, Homo sapiens
  Light chain CDR3 for antibody 12318 (IGKV3-11)
QQRSTWPALT

SEQ ID NO: 24636 - protein, 12 aa, Homo sapiens
  Heavy chain CDR3 for antibody 12318 (IGHV3-23)
AKGYTSFWYFDL

SEQ ID NO: 24637 - protein, 10 aa, Homo sapiens
  Light chain CDR3 for antibody 12319 (IGKV3-11)
QQRSNWPALA

SEQ ID NO: 24638 - protein, 12 aa, Homo sapiens
  Heavy chain CDR3 for antibody 12319 (IGHV1-18)
AGVLFDGDYSDY

SEQ ID NO: 24639 - protein, 9 aa, Homo sapiens
  Light chain CDR3 for antibody 12320 (IGKV3D-7)
QQDYTLPLT

SEQ ID NO: 24640 - protein, 14 aa, Homo sapiens
  Heavy chain CDR3 for antibody 12320 (IGHV3-33)
AREEDYYYYYDMDV

SEQ ID NO: 24641 - protein, 9 aa, Homo sapiens
  Light chain CDR3 for antibody 12321 (IGKV1-39)
QQSYSTPFT

SEQ ID NO: 24642 - protein, 14 aa, Homo sapiens
  Heavy chain CDR3 for antibody 12321 (IGHV4-59)
ARDFLVRGVAPFDY

SEQ ID NO: 24643 - protein, 9 aa, Homo sapiens
  Light chain CDR3 for antibody 12322 (IGKV1-6)
LQDFHYPWT

SEQ ID NO: 24644 - protein, 8 aa, Homo sapiens
  Heavy chain CDR3 for antibody 12322 (IGHV3-23)
AETFLFDY

SEQ ID NO: 24645 - protein, 9 aa, Homo sapiens
  Light chain CDR3 for antibody 12323 (IGKV1-6)
LQVYSYPWT

SEQ ID NO: 24646 - protein, 12 aa, Homo sapiens
  Heavy chain CDR3 for antibody 12323 (IGHV3-23)
AKDGWFGESLDY

SEQ ID NO: 24647 - protein, 9 aa, Homo sapiens
  Light chain CDR3 for antibody 12324 (IGKV3-11)
QQRSSWPPT

SEQ ID NO: 24648 - protein, 15 aa, Homo sapiens
  Heavy chain CDR3 for antibody 12324 (IGHV3-33)
ARDHLTGYYYYGMDV

SEQ ID NO: 24649 - protein, 9 aa, Homo sapiens
  Light chain CDR3 for antibody 12325 (IGKV6-21)
HQSSSLPYT

SEQ ID NO: 24650 - protein, 12 aa, Homo sapiens
  Heavy chain CDR3 for antibody 12325 (IGHV3-30)
ARDFTGHYTSDV

SEQ ID NO: 24651 - protein, 9 aa, Homo sapiens
  Light chain CDR3 for antibody 12326 (IGKV2-30)
MQGTHWPLT

SEQ ID NO: 24652 - protein, 14 aa, Homo sapiens
  Heavy chain CDR3 for antibody 12326 (IGHV1-46)
ARSYYDILTGAFDI

SEQ ID NO: 24653 - protein, 8 aa, Homo sapiens
  Light chain CDR3 for antibody 12327 (IGKV3-20)
QQYGRSLT

SEQ ID NO: 24654 - protein, 16 aa, Homo sapiens
  Heavy chain CDR3 for antibody 12327 (IGHV4-59)
AGGSGSYRDYYYGMDV

SEQ ID NO: 24655 - protein, 8 aa, Homo sapiens
  Light chain CDR3 for antibody 12328 (IGKV3D-7)
QQDYSLLT

SEQ ID NO: 24656 - protein, 11 aa, Homo sapiens
  Heavy chain CDR3 for antibody 12328 (IGHV3-33)
ARDRATATVDY

SEQ ID NO: 24657 - protein, 9 aa, Homo sapiens
  Light chain CDR3 for antibody 12329 (IGKV1-16)
QQYKSYPYT

SEQ ID NO: 24658 - protein, 15 aa, Homo sapiens
  Heavy chain CDR3 for antibody 12329 (IGHV3-33)
AREGLRYFHYYGMDV

SEQ ID NO: 24659 - protein, 9 aa, Homo sapiens
  Light chain CDR3 for antibody 12330 (IGKV1-6)
LQDFNYPRT

SEQ ID NO: 24660 - protein, 16 aa, Homo sapiens
  Heavy chain CDR3 for antibody 12330 (IGHV4-59)
ARYSGSYYRDYYGMDV

SEQ ID NO: 24661 - protein, 10 aa, Homo sapiens
  Light chain CDR3 for antibody 12331 (IGKV1-17)
LQHNSYPMYT

SEQ ID NO: 24662 - protein, 13 aa, Homo sapiens
  Heavy chain CDR3 for antibody 12331 (IGHV4-39)
ARHPPSRDYGMDV

SEQ ID NO: 24663 - protein, 8 aa, Homo sapiens
  Light chain CDR3 for antibody 12332 (IGKV1-17)
QQDYNLLT

SEQ ID NO: 24664 - protein, 13 aa, Homo sapiens
  Heavy chain CDR3 for antibody 12332 (IGHV1-18)
ARGGGVRGAPLDY

SEQ ID NO: 24665 - protein, 9 aa, Homo sapiens
  Light chain CDR3 for antibody 12333 (IGKV1-39)
QQSYSSPFT

SEQ ID NO: 24666 - protein, 13 aa, Homo sapiens
  Heavy chain CDR3 for antibody 12333 (IGHV3-33)
ARVKLGSLGAFDI

SEQ ID NO: 24667 - protein, 9 aa, Homo sapiens
  Light chain CDR3 for antibody 12334 (IGKV6-21)
HQSSNLPYT

SEQ ID NO: 24668 - protein, 18 aa, Homo sapiens
  Heavy chain CDR3 for antibody 12334 (IGHV1-46)
ARDGYYVWGSYRCNWFDP

SEQ ID NO: 24669 - protein, 9 aa, Homo sapiens
  Light chain CDR3 for antibody 12335 (IGKV6-21)
HQSYSLPHT

SEQ ID NO: 24670 - protein, 13 aa, Homo sapiens
  Heavy chain CDR3 for antibody 12335 (IGHV3-64)
ARRATLVQGVCDP

SEQ ID NO: 24671 - protein, 10 aa, Homo sapiens
  Light chain CDR3 for antibody 12336 (IGKV1-9)
QQLDSYPMYT

SEQ ID NO: 24672 - protein, 17 aa, Homo sapiens
  Heavy chain CDR3 for antibody 12336 (IGHV3-33)
ARAYYDILTGYSYYFDY

SEQ ID NO: 24673 - protein, 8 aa, Homo sapiens
  Light chain CDR3 for antibody 12337 (IGKV6-21)
QQSSSLPT

SEQ ID NO: 24674 - protein, 15 aa, Homo sapiens
  Heavy chain CDR3 for antibody 12337 (IGHV3-23)
AKEALRYFDWSGMDV

SEQ ID NO: 24675 - protein, 9 aa, Homo sapiens
  Light chain CDR3 for antibody 12338 (IGKV1-16)
QQYIRYPYT

SEQ ID NO: 24676 - protein, 12 aa, Homo sapiens
  Heavy chain CDR3 for antibody 12338 (IGHV4-59)
AREAGIPDAFDI

SEQ ID NO: 24677 - protein, 9 aa, Homo sapiens
  Light chain CDR3 for antibody 12339 (IGKV1-9)
QQLNSYPYT

SEQ ID NO: 24678 - protein, 12 aa, Homo sapiens
  Heavy chain CDR3 for antibody 12339 (IGHV3-13)
AREAGIPDACDI

SEQ ID NO: 24679 - protein, 9 aa, Homo sapiens
  Light chain CDR3 for antibody 12340 (IGKV1-6)
LQGYNYPRS

SEQ ID NO: 24680 - protein, 15 aa, Homo sapiens
  Heavy chain CDR3 for antibody 12340 (IGHV3-30)
ARGAMVRGVDYGMDV

SEQ ID NO: 24681 - protein, 10 aa, Homo sapiens
  Light chain CDR3 for antibody 12341 (IGKV3-15)
QQYNNWPPIT

SEQ ID NO: 24682 - protein, 14 aa, Homo sapiens
  Heavy chain CDR3 for antibody 12341 (IGHV3-33)
ARDGYDILTGPFDY

SEQ ID NO: 24683 - protein, 9 aa, Homo sapiens
  Light chain CDR3 for antibody 12342 (IGKV1-17)
LQHNSYPLT

SEQ ID NO: 24684 - protein, 15 aa, Homo sapiens
  Heavy chain CDR3 for antibody 12342 (IGHV4-39)
ARRDYDILTGYLFDY

SEQ ID NO: 24685 - protein, 9 aa, Homo sapiens
  Light chain CDR3 for antibody 12343 (IGKV3-20)
QQYNRYPYT

SEQ ID NO: 24686 - protein, 13 aa, Homo sapiens
  Heavy chain CDR3 for antibody 12343 (IGHV4-39)
ARPGIVAAGWFDP

SEQ ID NO: 24687 - protein, 9 aa, Homo sapiens
  Light chain CDR3 for antibody 12344 (IGKV1D-16)
LQHNSYPPT

SEQ ID NO: 24688 - protein, 19 aa, Homo sapiens
  Heavy chain CDR3 for antibody 12344 (IGHV3-20)
ARDPPTQALHYYYYYGMDV

SEQ ID NO: 24689 - protein, 8 aa, Homo sapiens
  Light chain CDR3 for antibody 12345 (IGKV3D-7)
QQDYNLLT

SEQ ID NO: 24690 - protein, 18 aa, Homo sapiens
  Heavy chain CDR3 for antibody 12345 (IGHV3-33)
AREGYDILTGYYNVKFHY

SEQ ID NO: 24691 - protein, 9 aa, Homo sapiens
  Light chain CDR3 for antibody 12346 (IGKV4-1)
QQYYSTPLT

SEQ ID NO: 24692 - protein, 17 aa, Homo sapiens
  Heavy chain CDR3 for antibody 12346 (IGHV1-18)
ARERYYGSGNYKYNMDV

SEQ ID NO: 24693 - protein, 10 aa, Homo sapiens
  Light chain CDR3 for antibody 12347 (IGKV1-17)
LQHNSYPMYT

SEQ ID NO: 24694 - protein, 17 aa, Homo sapiens
  Heavy chain CDR3 for antibody 12347 (IGHV3-33)
ARDQDDILTGYYWYFDL

SEQ ID NO: 24695 - protein, 9 aa, Homo sapiens
  Light chain CDR3 for antibody 12348 (IGKV6-21)
HQSSSLPLT

SEQ ID NO: 24696 - protein, 10 aa, Homo sapiens
  Heavy chain CDR3 for antibody 12348 (IGHV4-59)
VSSGTSLLAY

SEQ ID NO: 24697 - protein, 10 aa, Homo sapiens
  Light chain CDR3 for antibody 12349 (IGKV1-27)
QQLDSYPMYT

SEQ ID NO: 24698 - protein, 14 aa, Homo sapiens
  Heavy chain CDR3 for antibody 12349 (IGHV3-23)
AKSRIVGALYYFDY

SEQ ID NO: 24699 - protein, 9 aa, Homo sapiens
  Light chain CDR3 for antibody 12350 (IGKV1-39)
QQGFSTPWT

SEQ ID NO: 24700 - protein, 16 aa, Homo sapiens
  Heavy chain CDR3 for antibody 12350 (IGHV4-39)
AREVAGSYYYYYGIDV

SEQ ID NO: 24701 - protein, 10 aa, Homo sapiens
  Light chain CDR3 for antibody 12351 (IGKV3-11)
QQRSNWPMYT

SEQ ID NO: 24702 - protein, 10 aa, Homo sapiens
  Heavy chain CDR3 for antibody 12351 (IGHV3-23)
AKEQWLVPDY

SEQ ID NO: 24703 - protein, 9 aa, Homo sapiens
  Light chain CDR3 for antibody 12352 (IGKV3-15)
QQYNNWPYT

SEQ ID NO: 24704 - protein, 19 aa, Homo sapiens
  Heavy chain CDR3 for antibody 12352 (IGHV3-33)
ARGRGSYYYGPGSHYGMDV

SEQ ID NO: 24705 - protein, 9 aa, Homo sapiens
  Light chain CDR3 for antibody 12353 (IGKV1D-16)
QQYNSYPPT

SEQ ID NO: 24706 - protein, 12 aa, Homo sapiens
  Heavy chain CDR3 for antibody 12353 (IGHV3-66)
ARELEQQLVFDY

SEQ ID NO: 24707 - protein, 8 aa, Homo sapiens
  Light chain CDR3 for antibody 12354 (IGKV3-11)
QQRSNWLT

SEQ ID NO: 24708 - protein, 15 aa, Homo sapiens
  Heavy chain CDR3 for antibody 12354 (IGHV1-46)
ARGAVDDYYYYGMDV

SEQ ID NO: 24709 - protein, 9 aa, Homo sapiens
  Light chain CDR3 for antibody 12355 (IGKV3D-7)
QQAYTLPLT

SEQ ID NO: 24710 - protein, 9 aa, Homo sapiens
  Heavy chain CDR3 for antibody 12355 (IGHV3-33)
ARELAYFDY

SEQ ID NO: 24711 - protein, 9 aa, Homo sapiens
  Light chain CDR3 for antibody 12356 (IGKV3-20)
QQYGSSPRT

SEQ ID NO: 24712 - protein, 13 aa, Homo sapiens
  Heavy chain CDR3 for antibody 12356 (IGHV3-33)
ASAGNSYYNVMDV

SEQ ID NO: 24713 - protein, 6 aa, Homo sapiens
  Light chain CDR3 for antibody 12357 (IGKV3-20)
QQYGST

SEQ ID NO: 24714 - protein, 8 aa, Homo sapiens
  Heavy chain CDR3 for antibody 12357 (IGHV3-23)
AETFLFDY

SEQ ID NO: 24715 - protein, 9 aa, Homo sapiens
  Light chain CDR3 for antibody 12358 (IGKV3-11)
QQRSDWPLT

SEQ ID NO: 24716 - protein, 12 aa, Homo sapiens
  Heavy chain CDR3 for antibody 12358 (IGHV3-33)
AREGIAVAGVDP

SEQ ID NO: 24717 - protein, 9 aa, Homo sapiens
  Light chain CDR3 for antibody 12359 (IGKV3-15)
QQYNNWPYT

SEQ ID NO: 24718 - protein, 10 aa, Homo sapiens
  Heavy chain CDR3 for antibody 12359 (IGHV3-33)
ARNILTPLDY

SEQ ID NO: 24719 - protein, 9 aa, Homo sapiens
  Light chain CDR3 for antibody 12360 (IGKV1-17)
LQHNSYPYT

SEQ ID NO: 24720 - protein, 17 aa, Homo sapiens
  Heavy chain CDR3 for antibody 12360 (IGHV4-34)
ARDGSGSYTHYYYGMDV

SEQ ID NO: 24721 - protein, 9 aa, Homo sapiens
  Light chain CDR3 for antibody 12361 (IGKV1D-16)
QQYYSYPPT

SEQ ID NO: 24722 - protein, 9 aa, Homo sapiens
  Heavy chain CDR3 for antibody 12361 (IGHV4-59)
AGGSWDFDY

SEQ ID NO: 24723 - protein, 9 aa, Homo sapiens
  Light chain CDR3 for antibody 12362 (IGKV1-33)
QQFNNYMYT

SEQ ID NO: 24724 - protein, 26 aa, Homo sapiens
  Heavy chain CDR3 for antibody 12362 (IGHV3-11)
ARQGLLWFGDLKAYDSSGYYYGYFHH

SEQ ID NO: 24725 - protein, 9 aa, Homo sapiens
  Light chain CDR3 for antibody 12363 (IGKV1D-13)
QRFNNYLYT

SEQ ID NO: 24726 - protein, 14 aa, Homo sapiens
  Heavy chain CDR3 for antibody 12363 (IGHV3-23)
AKSRIVGALYYFDY

SEQ ID NO: 24727 - protein, 9 aa, Homo sapiens
  Light chain CDR3 for antibody 12364 (IGKV2-30)
MQGTHWPLT

SEQ ID NO: 24728 - protein, 12 aa, Homo sapiens
  Heavy chain CDR3 for antibody 12364 (IGHV3-11)
ARESGGSFGMDV

SEQ ID NO: 24729 - protein, 9 aa, Homo sapiens
  Light chain CDR3 for antibody 12365 (IGKV3-11)
QQRSNWPPT

SEQ ID NO: 24730 - protein, 14 aa, Homo sapiens
  Heavy chain CDR3 for antibody 12365 (IGHV3-20)
ARDGGSGSYDGLDV

SEQ ID NO: 24731 - protein, 9 aa, Homo sapiens
  Light chain CDR3 for antibody 12366 (IGKV1-6)
QQFNNYPYT

SEQ ID NO: 24732 - protein, 12 aa, Homo sapiens
  Heavy chain CDR3 for antibody 12366 (IGHV3-33)
ARKAYALYVLDV

SEQ ID NO: 24733 - protein, 9 aa, Homo sapiens
  Light chain CDR3 for antibody 12367 (IGKV2-30)
MQGTHWPLT

SEQ ID NO: 24734 - protein, 11 aa, Homo sapiens
  Heavy chain CDR3 for antibody 12367 (IGHV4-59)
ARSIRYSVFDY

SEQ ID NO: 24735 - protein, 9 aa, Homo sapiens
  Light chain CDR3 for antibody 12368 (IGKV3-11)
QQRSSWPPT

SEQ ID NO: 24736 - protein, 13 aa, Homo sapiens
  Heavy chain CDR3 for antibody 12368 (IGHV3-33)
ARVDTMVRGVMAY

SEQ ID NO: 24737 - protein, 9 aa, Homo sapiens
  Light chain CDR3 for antibody 12369 (IGKV1-39)
QQSYSTPYT

SEQ ID NO: 24738 - protein, 14 aa, Homo sapiens
  Heavy chain CDR3 for antibody 12369 (IGHV3-23)
AKDDIVRATGAFDI

SEQ ID NO: 24739 - protein, 9 aa, Homo sapiens
  Light chain CDR3 for antibody 12370 (IGKV1D-13)
QQFNNYPHT

SEQ ID NO: 24740 - protein, 16 aa, Homo sapiens
  Heavy chain CDR3 for antibody 12370 (IGHV3-33)
ARPTYYDILTGYPFDY

SEQ ID NO: 24741 - protein, 11 aa, Homo sapiens
  Light chain CDR3 for antibody 12371 (IGKV3-11)
QQRSNWPPTWT

SEQ ID NO: 24742 - protein, 11 aa, Homo sapiens
  Heavy chain CDR3 for antibody 12371 (IGHV4-59)
VRERGYYGMDV

SEQ ID NO: 24743 - protein, 9 aa, Homo sapiens
  Light chain CDR3 for antibody 12372 (IGKV1-6)
LQDYKSPFT

SEQ ID NO: 24744 - protein, 17 aa, Homo sapiens
  Heavy chain CDR3 for antibody 12372 (IGHV3-13)
AREGWFGELWGYYGMDV

SEQ ID NO: 24745 - protein, 9 aa, Homo sapiens
  Light chain CDR3 for antibody 12373 (IGKV1D-16)
QQYNSYPLT

SEQ ID NO: 24746 - protein, 11 aa, Homo sapiens
  Heavy chain CDR3 for antibody 12373 (IGHV4-59)
AREMGHDPFDI

SEQ ID NO: 24747 - protein, 8 aa, Homo sapiens
  Light chain CDR3 for antibody 12374 (IGKV1D-13)
QQFNTYYT

SEQ ID NO: 24748 - protein, 16 aa, Homo sapiens
  Heavy chain CDR3 for antibody 12374 (IGHV4-59)
ARYSGSYYGDYYGMDV

SEQ ID NO: 24749 - protein, 9 aa, Homo sapiens
  Light chain CDR3 for antibody 12375 (IGKV1-17)
LHSNNYPWT

SEQ ID NO: 24750 - protein, 14 aa, Homo sapiens
  Heavy chain CDR3 for antibody 12375 (IGHV3-23)
AKSRIVGALYYFDY

SEQ ID NO: 24751 - protein, 10 aa, Homo sapiens
  Light chain CDR3 for antibody 12376 (IGKV3-11)
QQRSNWPALT

SEQ ID NO: 24752 - protein, 10 aa, Homo sapiens
  Heavy chain CDR3 for antibody 12376 (IGHV3-23)
ARDNFEGMDV

SEQ ID NO: 24753 - protein, 9 aa, Homo sapiens
  Light chain CDR3 for antibody 12377 (IGKV5-2)
LQHDKFPYT

SEQ ID NO: 24754 - protein, 14 aa, Homo sapiens
  Heavy chain CDR3 for antibody 12377 (IGHV3-33)
ARKPDYYGSGYFDY

SEQ ID NO: 24755 - protein, 11 aa, Homo sapiens
  Light chain CDR3 for antibody 12378 (IGKV1-6)
QQRSNWPPTWT

SEQ ID NO: 24756 - protein, 11 aa, Homo sapiens
  Heavy chain CDR3 for antibody 12378 (IGHV4-4)
AREAYYYGLDV

SEQ ID NO: 24757 - protein, 9 aa, Homo sapiens
  Light chain CDR3 for antibody 12379 (IGKV3-11)
QQRSNWPPT

SEQ ID NO: 24758 - protein, 14 aa, Homo sapiens
  Heavy chain CDR3 for antibody 12379 (IGHV3-33)
ARDYGSGSYSPFDY

SEQ ID NO: 24759 - protein, 9 aa, Homo sapiens
  Light chain CDR3 for antibody 12380 (IGKV3-15)
QQYSNWPRT

SEQ ID NO: 24760 - protein, 12 aa, Homo sapiens
  Heavy chain CDR3 for antibody 12380 (IGHV1-18)
ARRDGSGTSFDY

SEQ ID NO: 24761 - protein, 7 aa, Homo sapiens
  Light chain CDR3 for antibody 12381 (IGKV3-11)
QQRSKFT

SEQ ID NO: 24762 - protein, 20 aa, Homo sapiens
  Heavy chain CDR3 for antibody 12381 (IGHV1-46)
ARDLCSSTSCYGYYYYGMDV

SEQ ID NO: 24763 - protein, 9 aa, Homo sapiens
  Light chain CDR3 for antibody 12382 (IGKV1-37)
QRTYNAPFT

SEQ ID NO: 24764 - protein, 12 aa, Homo sapiens
  Heavy chain CDR3 for antibody 12382 (IGHV3-33)
ARVDTAAPYFDY

SEQ ID NO: 24765 - protein, 8 aa, Homo sapiens
  Light chain CDR3 for antibody 12383 (IGKV3-15)
QQYNNWPT

SEQ ID NO: 24766 - protein, 9 aa, Homo sapiens
  Heavy chain CDR3 for antibody 12383 (IGHV1-18)
ARGKDWFDP

SEQ ID NO: 24767 - protein, 8 aa, Homo sapiens
  Light chain CDR3 for antibody 12384 (IGKV1D-13)
QQFNNYPT

SEQ ID NO: 24768 - protein, 19 aa, Homo sapiens
  Heavy chain CDR3 for antibody 12384 (IGHV3-33)
ARIPGIAVAGGYYYYSMDV

SEQ ID NO: 24769 - protein, 9 aa, Homo sapiens
  Light chain CDR3 for antibody 12385 (IGKV1-6)
LQDYNYPYT

SEQ ID NO: 24770 - protein, 14 aa, Homo sapiens
  Heavy chain CDR3 for antibody 12385 (IGHV3-33)
AREMVRGVPNWFDH

SEQ ID NO: 24771 - protein, 9 aa, Homo sapiens
  Light chain CDR3 for antibody 12386 (IGKV2-30)
MQGTHWPLT

SEQ ID NO: 24772 - protein, 23 aa, Homo sapiens
  Heavy chain CDR3 for antibody 12386 (IGHV1-18)
ARNLHYDILTGYFPYYFYYGMDV

SEQ ID NO: 24773 - protein, 9 aa, Homo sapiens
  Light chain CDR3 for antibody 12387 (IGKV3-11)
QQRSSWPPT

SEQ ID NO: 24774 - protein, 18 aa, Homo sapiens
  Heavy chain CDR3 for antibody 12387 (IGHV3-33)
ARGLLWFGVSYYYYCMDV

SEQ ID NO: 24775 - protein, 9 aa, Homo sapiens
  Light chain CDR3 for antibody 12388 (IGKV1-9)
QQGNTYSRT

SEQ ID NO: 24776 - protein, 16 aa, Homo sapiens
  Heavy chain CDR3 for antibody 12388 (IGHV4-59)
ARYSGSYYGDYYGMDV

SEQ ID NO: 24777 - protein, 9 aa, Homo sapiens
  Light chain CDR3 for antibody 12389 (IGKV1-17)
LQHYSYPPT

SEQ ID NO: 24778 - protein, 13 aa, Homo sapiens
  Heavy chain CDR3 for antibody 12389 (IGHV3-33)
ARAFIMVRGVIDY

SEQ ID NO: 24779 - protein, 9 aa, Homo sapiens
  Light chain CDR3 for antibody 12390 (IGKV1-6)
LQDYNYPRT

SEQ ID NO: 24780 - protein, 15 aa, Homo sapiens
  Heavy chain CDR3 for antibody 12390 (IGHV3-33)
ARVPNYGSGSYFFDY

SEQ ID NO: 24781 - protein, 8 aa, Homo sapiens
  Light chain CDR3 for antibody 12391 (IGKV1-5)
QQYNSYWT

SEQ ID NO: 24782 - protein, 13 aa, Homo sapiens
  Heavy chain CDR3 for antibody 12391 (IGHV3-33)
ARGDNWNDGGFDY

SEQ ID NO: 24783 - protein, 9 aa, Homo sapiens
  Light chain CDR3 for antibody 12392 (IGKV1-9)
QQLNTYPWT

SEQ ID NO: 24784 - protein, 14 aa, Homo sapiens
  Heavy chain CDR3 for antibody 12392 (IGHV3-33)
ARDREQQLVRYFDY

SEQ ID NO: 24785 - protein, 9 aa, Homo sapiens
  Light chain CDR3 for antibody 12393 (IGKV1-17)
LQQNSYPWT

SEQ ID NO: 24786 - protein, 23 aa, Homo sapiens
  Heavy chain CDR3 for antibody 12393 (IGHV4-59)
ARERTYSGILPGYYEDYYYGMDV

SEQ ID NO: 24787 - protein, 9 aa, Homo sapiens
  Light chain CDR3 for antibody 12394 (IGKV3-11)
QQRSNWPYT

SEQ ID NO: 24788 - protein, 18 aa, Homo sapiens
  Heavy chain CDR3 for antibody 12394 (IGHV3-33)
AREGYDILTGDYRLGFDY

SEQ ID NO: 24789 - protein, 9 aa, Homo sapiens
  Light chain CDR3 for antibody 12395 (IGKV6-21)
HQSSSLPYT

SEQ ID NO: 24790 - protein, 10 aa, Homo sapiens
  Heavy chain CDR3 for antibody 12395 (IGHV3-23)
AKEGMVLRYV

SEQ ID NO: 24791 - protein, 9 aa, Homo sapiens
  Light chain CDR3 for antibody 12396 (IGKV1-9)
QQLNSYPYT

SEQ ID NO: 24792 - protein, 18 aa, Homo sapiens
  Heavy chain CDR3 for antibody 12396 (IGHV3-33)
AREGSYYGSGSFPNWFDH

SEQ ID NO: 24793 - protein, 9 aa, Homo sapiens
  Light chain CDR3 for antibody 12397 (IGKV6-21)
HQSSSLPYT

SEQ ID NO: 24794 - protein, 14 aa, Homo sapiens
  Heavy chain CDR3 for antibody 12397 (IGHV1-18)
ARDQPTVPSGYFDY

SEQ ID NO: 24795 - protein, 9 aa, Homo sapiens
  Light chain CDR3 for antibody 12398 (IGKV2-30)
MQGTHWPLT

SEQ ID NO: 24796 - protein, 18 aa, Homo sapiens
  Heavy chain CDR3 for antibody 12398 (IGHV3-33)
AREIAAAGTKGLYYGMDV

SEQ ID NO: 24797 - protein, 9 aa, Homo sapiens
  Light chain CDR3 for antibody 12399 (IGKV3D-7)
QQDYTLPLT

SEQ ID NO: 24798 - protein, 12 aa, Homo sapiens
  Heavy chain CDR3 for antibody 12399 (IGHV6-1)
ARLDWNYRAFDI

SEQ ID NO: 24799 - protein, 9 aa, Homo sapiens
  Light chain CDR3 for antibody 12400 (IGKV1D-16)
QQYITYPYT

SEQ ID NO: 24800 - protein, 14 aa, Homo sapiens
  Heavy chain CDR3 for antibody 12400 (IGHV3-23)
AKSRIVGALYYFDY

SEQ ID NO: 24801 - protein, 8 aa, Homo sapiens
  Light chain CDR3 for antibody 12401 (IGKV1D-16)
QQYNYPFT

SEQ ID NO: 24802 - protein, 18 aa, Homo sapiens
  Heavy chain CDR3 for antibody 12401 (IGHV1-46)
ARDGDYVWGSYRSDWFDP

SEQ ID NO: 24803 - protein, 9 aa, Homo sapiens
  Light chain CDR3 for antibody 12402 (IGKV1D-13)
QQFNNYPHT

SEQ ID NO: 24804 - protein, 16 aa, Homo sapiens
  Heavy chain CDR3 for antibody 12402 (IGHV3-33)
ARGEQWLGYYYYGMDV

SEQ ID NO: 24805 - protein, 9 aa, Homo sapiens
  Light chain CDR3 for antibody 12403 (IGKV1-9)
QQLYTYPYT

SEQ ID NO: 24806 - protein, 13 aa, Homo sapiens
  Heavy chain CDR3 for antibody 12403 (IGHV3-23)
ASTGDSYYYGMDV

SEQ ID NO: 24807 - protein, 10 aa, Homo sapiens
  Light chain CDR3 for antibody 12404 (IGKV1-17)
LQHNSYPIYT

SEQ ID NO: 24808 - protein, 17 aa, Homo sapiens
  Heavy chain CDR3 for antibody 12404 (IGHV3-33)
AREDYDILTGYPFYFDY

SEQ ID NO: 24809 - protein, 9 aa, Homo sapiens
  Light chain CDR3 for antibody 12405 (IGKV6-21)
HQSYSLPHT

SEQ ID NO: 24810 - protein, 18 aa, Homo sapiens
  Heavy chain CDR3 for antibody 12405 (IGHV4-59)
AREGDYVWGSYRPNWLDP

SEQ ID NO: 24811 - protein, 9 aa, Homo sapiens
  Light chain CDR3 for antibody 12406 (IGKV1D-16)
QQYSSYPYT

SEQ ID NO: 24812 - protein, 15 aa, Homo sapiens
  Heavy chain CDR3 for antibody 12406 (IGHV3-23)
AKDGSYSYYYYGMDV

SEQ ID NO: 24813 - protein, 9 aa, Homo sapiens
  Light chain CDR3 for antibody 12407 (IGKV1D-16)
QQYHSYPYT

SEQ ID NO: 24814 - protein, 12 aa, Homo sapiens
  Heavy chain CDR3 for antibody 12407 (IGHV1-46)
STGLTGLPASYI

SEQ ID NO: 24815 - protein, 10 aa, Homo sapiens
  Light chain CDR3 for antibody 12408 (IGKV3-11)
QQRSNWPIFT

SEQ ID NO: 24816 - protein, 19 aa, Homo sapiens
  Heavy chain CDR3 for antibody 12408 (IGHV1-18)
ARGGHIGVVTAFHGYGMDV

SEQ ID NO: 24817 - protein, 9 aa, Homo sapiens
  Light chain CDR3 for antibody 12409 (IGKV1-6)
LQDYNYPFT

SEQ ID NO: 24818 - protein, 16 aa, Homo sapiens
  Heavy chain CDR3 for antibody 12409 (IGHV4-59)
ARGRYFDWLSGDVFDI

SEQ ID NO: 24819 - protein, 9 aa, Homo sapiens
  Light chain CDR3 for antibody 12410 (IGKV3-20)
QQYGSSPYT

SEQ ID NO: 24820 - protein, 19 aa, Homo sapiens
  Heavy chain CDR3 for antibody 12410 (IGHV1-46)
ARGDSLLWFGELLPDAFDI

SEQ ID NO: 24821 - protein, 9 aa, Homo sapiens
  Light chain CDR3 for antibody 12411 (IGKV3-11)
QQRSSWPPT

SEQ ID NO: 24822 - protein, 20 aa, Homo sapiens
  Heavy chain CDR3 for antibody 12411 (IGHV3-33)
ARDWMVRGVIITDYYYGMAV

SEQ ID NO: 24823 - protein, 9 aa, Homo sapiens
  Light chain CDR3 for antibody 12412 (IGKV3-15)
QQYHNWPLT

SEQ ID NO: 24824 - protein, 16 aa, Homo sapiens
  Heavy chain CDR3 for antibody 12412 (IGHV3-33)
ARGYDMLTGDYYGMDV

SEQ ID NO: 24825 - protein, 8 aa, Homo sapiens
  Light chain CDR3 for antibody 12413 (IGKV3-15)
QQYNNWPT

SEQ ID NO: 24826 - protein, 14 aa, Homo sapiens
  Heavy chain CDR3 for antibody 12413 (IGHV3-33)
ARASSGSSYWYFDL

SEQ ID NO: 24827 - protein, 10 aa, Homo sapiens
  Light chain CDR3 for antibody 12414 (IGKV3-11)
QQRSNWPIFT

SEQ ID NO: 24828 - protein, 14 aa, Homo sapiens
  Heavy chain CDR3 for antibody 12414 (IGHV1-46)
ARRGIVGALDAFDI

SEQ ID NO: 24829 - protein, 9 aa, Homo sapiens
  Light chain CDR3 for antibody 12415 (IGKV3-11)
QQYSNWPPT

SEQ ID NO: 24830 - protein, 11 aa, Homo sapiens
  Heavy chain CDR3 for antibody 12415 (IGHV3-33)
ARDQGGSSFDY

SEQ ID NO: 24831 - protein, 10 aa, Homo sapiens
  Light chain CDR3 for antibody 12416 (IGKV3-11)
QQRSNWPALT

SEQ ID NO: 24832 - protein, 12 aa, Homo sapiens
  Heavy chain CDR3 for antibody 12416 (IGHV3-33)
AREGIAVAGVDP

SEQ ID NO: 24833 - protein, 9 aa, Homo sapiens
  Light chain CDR3 for antibody 12417 (IGKV1D-13)
QRFNNYLYT

SEQ ID NO: 24834 - protein, 16 aa, Homo sapiens
  Heavy chain CDR3 for antibody 12417 (IGHV1-18)
ARYFDWLLRDYYGMDV

SEQ ID NO: 24835 - protein, 9 aa, Homo sapiens
  Light chain CDR3 for antibody 12418 (IGKV1-17)
LHSNNYPWT

SEQ ID NO: 24836 - protein, 13 aa, Homo sapiens
  Heavy chain CDR3 for antibody 12418 (IGHV3-33)
ASAGNSYYNVMDV

SEQ ID NO: 24837 - protein, 9 aa, Homo sapiens
  Light chain CDR3 for antibody 12419 (IGKV1-5)
QQYNTYSRT

SEQ ID NO: 24838 - protein, 14 aa, Homo sapiens
  Heavy chain CDR3 for antibody 12419 (IGHV3-33)
ARDREQQLVRYFDY

SEQ ID NO: 24839 - protein, 9 aa, Homo sapiens
  Light chain CDR3 for antibody 12420 (IGKV5-2)
LQHDNFPYT

SEQ ID NO: 24840 - protein, 13 aa, Homo sapiens
  Heavy chain CDR3 for antibody 12420 (IGHV4-39)
ARRDGSYYGYFGY

SEQ ID NO: 24841 - protein, 9 aa, Homo sapiens
  Light chain CDR3 for antibody 12421 (IGKV1-37)
QRTSNAPYT

SEQ ID NO: 24842 - protein, 10 aa, Homo sapiens
  Heavy chain CDR3 for antibody 12421 (IGHV3-23)
AKGDRWRFDP

SEQ ID NO: 24843 - protein, 10 aa, Homo sapiens
  Light chain CDR3 for antibody 12422 (IGKV1-17)
LQHNSYPMYT

SEQ ID NO: 24844 - protein, 18 aa, Homo sapiens
  Heavy chain CDR3 for antibody 12422 (IGHV3-33)
ARERGYYGSDIYPAAFDI

SEQ ID NO: 24845 - protein, 9 aa, Homo sapiens
  Light chain CDR3 for antibody 12423 (IGKV1-6)
LQVYSYPWT

SEQ ID NO: 24846 - protein, 17 aa, Homo sapiens
  Heavy chain CDR3 for antibody 12423 (IGHV4-59)
ARDFLVRGEGSYYGMDV

SEQ ID NO: 24847 - protein, 8 aa, Homo sapiens
  Light chain CDR3 for antibody 12424 (IGKV3-20)
QQYGSSLT

SEQ ID NO: 24848 - protein, 14 aa, Homo sapiens
  Heavy chain CDR3 for antibody 12424 (IGHV3-33)
ARRGSPLRPSHLDV

SEQ ID NO: 24849 - protein, 8 aa, Homo sapiens
  Light chain CDR3 for antibody 12425 (IGKV3-20)
QQYGSSLT

SEQ ID NO: 24850 - protein, 20 aa, Homo sapiens
  Heavy chain CDR3 for antibody 12425 (IGHV3-33)
AREDYYGSGSYYPAYNWFDP

SEQ ID NO: 24851 - protein, 9 aa, Homo sapiens
  Light chain CDR3 for antibody 12426 (IGKV1D-16)
QQYDSYPWT

SEQ ID NO: 24852 - protein, 17 aa, Homo sapiens
  Heavy chain CDR3 for antibody 12426 (IGHV3-33)
ARAYYDILTGYSYYCDY

SEQ ID NO: 24853 - protein, 10 aa, Homo sapiens
  Light chain CDR3 for antibody 12427 (IGKV3-11)
QQRSNWPIWT

SEQ ID NO: 24854 - protein, 15 aa, Homo sapiens
  Heavy chain CDR3 for antibody 12427 (IGHV3-66)
ARDRDYYYYYYGMDV

SEQ ID NO: 24855 - protein, 9 aa, Homo sapiens
  Light chain CDR3 for antibody 12428 (IGKV1-9)
QQLNSYPPT

SEQ ID NO: 24856 - protein, 14 aa, Homo sapiens
  Heavy chain CDR3 for antibody 12428 (IGHV1-46)
ARRGIVGALDAFDI

SEQ ID NO: 24857 - protein, 9 aa, Homo sapiens
  Light chain CDR3 for antibody 12429 (IGKV1-9)
QQLKSYLYT

SEQ ID NO: 24858 - protein, 13 aa, Homo sapiens
  Heavy chain CDR3 for antibody 12429 (IGHV3-33)
ARDQRYSSGWYDY

SEQ ID NO: 24859 - protein, 9 aa, Homo sapiens
  Light chain CDR3 for antibody 12430 (IGKV1-6)
LQDYKSPFT

SEQ ID NO: 24860 - protein, 13 aa, Homo sapiens
  Heavy chain CDR3 for antibody 12430 (IGHV3-21)
ARDSTLVRGVFPY

SEQ ID NO: 24861 - protein, 9 aa, Homo sapiens
  Light chain CDR3 for antibody 12431 (IGKV5-2)
LQHDNFPYT

SEQ ID NO: 24862 - protein, 12 aa, Homo sapiens
  Heavy chain CDR3 for antibody 12431 (IGHV3-30)
ARDFTGHYTSDV

SEQ ID NO: 24863 - protein, 10 aa, Homo sapiens
  Light chain CDR3 for antibody 12432 (IGKV1-9)
QQLDSYPMYT

SEQ ID NO: 24864 - protein, 12 aa, Homo sapiens
  Heavy chain CDR3 for antibody 12432 (IGHV3-13)
ARDRGYSGYFDY

SEQ ID NO: 24865 - protein, 9 aa, Homo sapiens
  Light chain CDR3 for antibody 12433 (IGKV1-6)
LQDYNYPFT

SEQ ID NO: 24866 - protein, 13 aa, Homo sapiens
  Heavy chain CDR3 for antibody 12433 (IGHV3-30)
ARVGDSVMVPFDY

SEQ ID NO: 24867 - protein, 9 aa, Homo sapiens
  Light chain CDR3 for antibody 12434 (IGKV6-21)
HQSYSLPHT

SEQ ID NO: 24868 - protein, 14 aa, Homo sapiens
  Heavy chain CDR3 for antibody 12434 (IGHV3-33)
ARDNILTVYYLFDY

SEQ ID NO: 24869 - protein, 10 aa, Homo sapiens
  Light chain CDR3 for antibody 12435 (IGKV3-11)
QQRSNWPPWT

SEQ ID NO: 24870 - protein, 12 aa, Homo sapiens
  Heavy chain CDR3 for antibody 12435 (IGHV3-23)
AKGAVVTAIFDY

SEQ ID NO: 24871 - protein, 9 aa, Homo sapiens
  Light chain CDR3 for antibody 12436 (IGKV1-9)
QQLISYPLT

SEQ ID NO: 24872 - protein, 7 aa, Homo sapiens
  Heavy chain CDR3 for antibody 12436 (IGHV1-46)
AREGGDY

SEQ ID NO: 24873 - protein, 9 aa, Homo sapiens
  Light chain CDR3 for antibody 12437 (IGKV3-11)
QQRSNWMYT

SEQ ID NO: 24874 - protein, 17 aa, Homo sapiens
  Heavy chain CDR3 for antibody 12437 (IGHV3-23)
AKGNYGSGSYYNGDFQH

SEQ ID NO: 24875 - protein, 8 aa, Homo sapiens
  Light chain CDR3 for antibody 12438 (IGKV2D-28)
MQALQTPT

SEQ ID NO: 24876 - protein, 16 aa, Homo sapiens
  Heavy chain CDR3 for antibody 12438 (IGHV4-59)
AGGSGSYRDYYYGIDV

SEQ ID NO: 24877 - protein, 10 aa, Homo sapiens
  Light chain CDR3 for antibody 12439 (IGKV3-11)
QQRSTWPTLT

SEQ ID NO: 24878 - protein, 16 aa, Homo sapiens
  Heavy chain CDR3 for antibody 12439 (IGHV3-33)
ARGGRSDWLYYYGMDV

SEQ ID NO: 24879 - protein, 9 aa, Homo sapiens
  Light chain CDR3 for antibody 12440 (IGKV2D-28)
MQALQTPPT

SEQ ID NO: 24880 - protein, 14 aa, Homo sapiens
  Heavy chain CDR3 for antibody 12440 (IGHV3-23)
AKSRIVGALYYFDY

SEQ ID NO: 24881 - protein, 9 aa, Homo sapiens
  Light chain CDR3 for antibody 12441 (IGKV6-21)
HQSTSLPFT

SEQ ID NO: 24882 - protein, 9 aa, Homo sapiens
  Heavy chain CDR3 for antibody 12441 (IGHV3-23)
AKEQLLFDY

SEQ ID NO: 24883 - protein, 9 aa, Homo sapiens
  Light chain CDR3 for antibody 12442 (IGKV1-39)
QQSYSTPYT

SEQ ID NO: 24884 - protein, 17 aa, Homo sapiens
  Heavy chain CDR3 for antibody 12442 (IGHV4-59)
ASRITMVREIIITAFDY

SEQ ID NO: 24885 - protein, 10 aa, Homo sapiens
  Light chain CDR3 for antibody 12443 (IGKV1-39)
QQSYSTPMYT

SEQ ID NO: 24886 - protein, 20 aa, Homo sapiens
  Heavy chain CDR3 for antibody 12443 (IGHV1-f)
ATGLITFVRGVILTYRSFDY

SEQ ID NO: 24887 - protein, 9 aa, Homo sapiens
  Light chain CDR3 for antibody 12444 (IGKV2-30)
MQGTHWPLT

SEQ ID NO: 24888 - protein, 14 aa, Homo sapiens
  Heavy chain CDR3 for antibody 12444 (IGHV3-33)
AKSYDILTGEAFDI

SEQ ID NO: 24889 - protein, 9 aa, Homo sapiens
  Light chain CDR3 for antibody 12445 (IGKV3D-20)
QQYGSSPYT

SEQ ID NO: 24890 - protein, 10 aa, Homo sapiens
  Heavy chain CDR3 for antibody 12445 (IGHV4-39)
ASSNWNDGPL

SEQ ID NO: 24891 - protein, 9 aa, Homo sapiens
  Light chain CDR3 for antibody 12446 (IGKV1-9)
QQLNSYPYT

SEQ ID NO: 24892 - protein, 14 aa, Homo sapiens
  Heavy chain CDR3 for antibody 12446 (IGHV3-33)
ARDWNDGYYYGMDL

SEQ ID NO: 24893 - protein, 10 aa, Homo sapiens
  Light chain CDR3 for antibody 12447 (IGKV1-39)
QQSYSSPMYT

SEQ ID NO: 24894 - protein, 8 aa, Homo sapiens
  Heavy chain CDR3 for antibody 12447 (IGHV4-39)
ARRGGLDY

SEQ ID NO: 24895 - protein, 9 aa, Homo sapiens
  Light chain CDR3 for antibody 12448 (IGKV1D-13)
QQFNNYPYT

SEQ ID NO: 24896 - protein, 10 aa, Homo sapiens
  Heavy chain CDR3 for antibody 12448 (IGHV3-23)
AKDRYGDYVY

SEQ ID NO: 24897 - protein, 9 aa, Homo sapiens
  Light chain CDR3 for antibody 12449 (IGKV1-39)
QQGFSTPWT

SEQ ID NO: 24898 - protein, 11 aa, Homo sapiens
  Heavy chain CDR3 for antibody 12449 (IGHV4-4)
AREAYYYGLDV

SEQ ID NO: 24899 - protein, 9 aa, Homo sapiens
  Light chain CDR3 for antibody 12450 (IGKV1-6)
LQDYKSPFT

SEQ ID NO: 24900 - protein, 16 aa, Homo sapiens
  Heavy chain CDR3 for antibody 12450 (IGHV3-23)
ARNWNDVGDYYYGMDV

SEQ ID NO: 24901 - protein, 9 aa, Homo sapiens
  Light chain CDR3 for antibody 12451 (IGKV1-17)
LQHNTYPYT

SEQ ID NO: 24902 - protein, 20 aa, Homo sapiens
  Heavy chain CDR3 for antibody 12451 (IGHV3-33)
ARRMVRGVKKTYYYYYGLEV

SEQ ID NO: 24903 - protein, 9 aa, Homo sapiens
  Light chain CDR3 for antibody 12452 (IGKV3-11)
QQYINWPLT

SEQ ID NO: 24904 - protein, 10 aa, Homo sapiens
  Heavy chain CDR3 for antibody 12452 (IGHV1-46)
AREWELLFDY

SEQ ID NO: 24905 - protein, 8 aa, Homo sapiens
  Light chain CDR3 for antibody 12453 (IGKV2D-28)
MQALQTPP

SEQ ID NO: 24906 - protein, 24 aa, Homo sapiens
  Heavy chain CDR3 for antibody 12453 (IGHV3-20)
ARGRITMVRGVIINPLDYYNGMDV

SEQ ID NO: 24907 - protein, 9 aa, Homo sapiens
  Light chain CDR3 for antibody 12454 (IGKV1D-16)
QQYITYPYT

SEQ ID NO: 24908 - protein, 17 aa, Homo sapiens
  Heavy chain CDR3 for antibody 12454 (IGHV1-18)
ARERYYGSGNYKYNMDV

SEQ ID NO: 24909 - protein, 9 aa, Homo sapiens
  Light chain CDR3 for antibody 12455 (IGKV1-39)
QQSYSTPYA

SEQ ID NO: 24910 - protein, 12 aa, Homo sapiens
  Heavy chain CDR3 for antibody 12455 (IGHV3-66)
ARGYFGSGYAHF

SEQ ID NO: 24911 - protein, 9 aa, Homo sapiens
  Light chain CDR3 for antibody 12456 (IGKV3-15)
QQYNNWPRT

SEQ ID NO: 24912 - protein, 12 aa, Homo sapiens
  Heavy chain CDR3 for antibody 12456 (IGHV3-23)
AKGYTSFWYFDL

SEQ ID NO: 24913 - protein, 10 aa, Homo sapiens
  Light chain CDR3 for antibody 12457 (IGKV1-9)
QQLNSFLMYT

SEQ ID NO: 24914 - protein, 15 aa, Homo sapiens
  Heavy chain CDR3 for antibody 12457 (IGHV4-59)
ARDLGHYYGSVSIDY

SEQ ID NO: 24915 - protein, 9 aa, Homo sapiens
  Light chain CDR3 for antibody 12458 (IGKV1-9)
QQGFSTPWT

SEQ ID NO: 24916 - protein, 13 aa, Homo sapiens
  Heavy chain CDR3 for antibody 12458 (IGHV4-39)
ARHVLLWFGEFDP

SEQ ID NO: 24917 - protein, 9 aa, Homo sapiens
  Light chain CDR3 for antibody 12459 (IGKV1D-13)
QQFNNYPYT

SEQ ID NO: 24918 - protein, 12 aa, Homo sapiens
  Heavy chain CDR3 for antibody 12459 (IGHV1-18)
ARVLFDGDYFDY

SEQ ID NO: 24919 - protein, 10 aa, Homo sapiens
  Light chain CDR3 for antibody 12460 (IGKV1-39)
QQSYSTPMYT

SEQ ID NO: 24920 - protein, 9 aa, Homo sapiens
  Heavy chain CDR3 for antibody 12460 (IGHV3-23)
AKEQQLFDY

SEQ ID NO: 24921 - protein, 9 aa, Homo sapiens
  Light chain CDR3 for antibody 12461 (IGKV1D-13)
QHFNNYMYT

SEQ ID NO: 24922 - protein, 17 aa, Homo sapiens
  Heavy chain CDR3 for antibody 12461 (IGHV3-33)
ARVRGVIEGYYYYGMDV

SEQ ID NO: 24923 - protein, 9 aa, Homo sapiens
  Light chain CDR3 for antibody 12462 (IGKV1-17)
LQHNSYPYT

SEQ ID NO: 24924 - protein, 12 aa, Homo sapiens
  Heavy chain CDR3 for antibody 12462 (IGHV3-33)
ASEYFGSGSAHY

SEQ ID NO: 24925 - protein, 9 aa, Homo sapiens
  Light chain CDR3 for antibody 12463 (IGKV3D-7)
QQDYEFPIT

SEQ ID NO: 24926 - protein, 13 aa, Homo sapiens
  Heavy chain CDR3 for antibody 12463 (IGHV4-59)
ARHPPSRDYGMDV

SEQ ID NO: 24927 - protein, 10 aa, Homo sapiens
  Light chain CDR3 for antibody 12464 (IGKV3-11)
QQRSNWPIFT

SEQ ID NO: 24928 - protein, 14 aa, Homo sapiens
  Heavy chain CDR3 for antibody 12464 (IGHV3-20)
ARDGGSGSYDGLDV

SEQ ID NO: 24929 - protein, 8 aa, Homo sapiens
  Light chain CDR3 for antibody 12465 (IGKV3D-7)
QQDYNLLT

SEQ ID NO: 24930 - protein, 20 aa, Homo sapiens
  Heavy chain CDR3 for antibody 12465 (IGHV3-33)
ARDLGWATMVRGVIRAPFDY

SEQ ID NO: 24931 - protein, 8 aa, Homo sapiens
  Light chain CDR3 for antibody 12466 (IGKV3D-7)
QQDYNSLT

SEQ ID NO: 24932 - protein, 17 aa, Homo sapiens
  Heavy chain CDR3 for antibody 12466 (IGHV3-33)
ARGGAAAGPYLYYGLDV

SEQ ID NO: 24933 - protein, 9 aa, Homo sapiens
  Light chain CDR3 for antibody 12467 (IGKV1-16)
QQYTSYPFT

SEQ ID NO: 24934 - protein, 19 aa, Homo sapiens
  Heavy chain CDR3 for antibody 12467 (IGHV4-59)
ARDRGYDILTGYSLDYFDY

SEQ ID NO: 24935 - protein, 9 aa, Homo sapiens
  Light chain CDR3 for antibody 12468 (IGKV3-20)
QHYGSSPYT

SEQ ID NO: 24936 - protein, 9 aa, Homo sapiens
  Heavy chain CDR3 for antibody 12468 (IGHV3-33)
AREYKEFDY

SEQ ID NO: 24937 - protein, 9 aa, Homo sapiens
  Light chain CDR3 for antibody 12469 (IGKV1D-13)
QQFNNYPLT

SEQ ID NO: 24938 - protein, 17 aa, Homo sapiens
  Heavy chain CDR3 for antibody 12469 (IGHV3-23)
AKAMVRGVHYHHYGMDV

SEQ ID NO: 24939 - protein, 10 aa, Homo sapiens
  Light chain CDR3 for antibody 12470 (IGKV1-39)
QQSYSTPMYT

SEQ ID NO: 24940 - protein, 12 aa, Homo sapiens
  Heavy chain CDR3 for antibody 12470 (IGHV1-18)
ARILFYGDYFDY

SEQ ID NO: 24941 - protein, 8 aa, Homo sapiens
  Light chain CDR3 for antibody 12471 (IGKV3D-7)
QQDYHLLT

SEQ ID NO: 24942 - protein, 15 aa, Homo sapiens
  Heavy chain CDR3 for antibody 12471 (IGHV3-33)
VRGYYYGSGSYPLNY

SEQ ID NO: 24943 - protein, 9 aa, Homo sapiens
  Light chain CDR3 for antibody 12472 (IGKV3D-7)
QQDYEFPIT

SEQ ID NO: 24944 - protein, 19 aa, Homo sapiens
  Heavy chain CDR3 for antibody 12472 (IGHV1-24)
ATAGLQWFGEKIGYYGMDV

SEQ ID NO: 24945 - protein, 9 aa, Homo sapiens
  Light chain CDR3 for antibody 12473 (IGKV1-16)
QQYNSYPYT

SEQ ID NO: 24946 - protein, 18 aa, Homo sapiens
  Heavy chain CDR3 for antibody 12473 (IGHV4-59)
ARERGNWNDVDYCYGMDV

SEQ ID NO: 24947 - protein, 9 aa, Homo sapiens
  Light chain CDR3 for antibody 12474 (IGKV1D-16)
QQYNSYPYT

SEQ ID NO: 24948 - protein, 14 aa, Homo sapiens
  Heavy chain CDR3 for antibody 12474 (IGHV3-33)
ARDYYDSGSYYFDY

SEQ ID NO: 24949 - protein, 9 aa, Homo sapiens
  Light chain CDR3 for antibody 12475 (IGKV3-15)
QQYNNWPRT

SEQ ID NO: 24950 - protein, 17 aa, Homo sapiens
  Heavy chain CDR3 for antibody 12475 (IGHV3-64)
ARERYYGSGSYYNWFDP

SEQ ID NO: 24951 - protein, 8 aa, Homo sapiens
  Light chain CDR3 for antibody 12476 (IGKV3-20)
QQYGSSLT

SEQ ID NO: 24952 - protein, 12 aa, Homo sapiens
  Heavy chain CDR3 for antibody 12476 (IGHV3-33)
ARDLGGATPFDY

SEQ ID NO: 24953 - protein, 10 aa, Homo sapiens
  Light chain CDR3 for antibody 12477 (IGKV3-20)
QQYGRSPPVT

SEQ ID NO: 24954 - protein, 15 aa, Homo sapiens
  Heavy chain CDR3 for antibody 12477 (IGHV3-33)
ARDHLTGYYYYGMDV

SEQ ID NO: 24955 - protein, 9 aa, Homo sapiens
  Light chain CDR3 for antibody 12478 (IGKV1-17)
LHSNNYPWT

SEQ ID NO: 24956 - protein, 16 aa, Homo sapiens
  Heavy chain CDR3 for antibody 12478 (IGHV3-33)
ARGGRSDWLYYYGMDV

SEQ ID NO: 24957 - protein, 9 aa, Homo sapiens
  Light chain CDR3 for antibody 12479 (IGKV1-17)
QQFNNYPHT

SEQ ID NO: 24958 - protein, 8 aa, Homo sapiens
  Heavy chain CDR3 for antibody 12479 (IGHV4-4)
ARGARFDP

SEQ ID NO: 24959 - protein, 8 aa, Homo sapiens
  Light chain CDR3 for antibody 12480 (IGKV3-15)
QQYNNYPT

SEQ ID NO: 24960 - protein, 12 aa, Homo sapiens
  Heavy chain CDR3 for antibody 12480 (IGHV3-33)
ARAGMGAPYFDY

SEQ ID NO: 24961 - protein, 10 aa, Homo sapiens
  Light chain CDR3 for antibody 12481 (IGKV1-17)
LQHNSYPMYT

SEQ ID NO: 24962 - protein, 16 aa, Homo sapiens
  Heavy chain CDR3 for antibody 12481 (IGHV3-33)
ARGDDILTHQYYGVDV

SEQ ID NO: 24963 - protein, 9 aa, Homo sapiens
  Light chain CDR3 for antibody 12482 (IGKV1-9)
QQLNSYPYT

SEQ ID NO: 24964 - protein, 11 aa, Homo sapiens
  Heavy chain CDR3 for antibody 12482 (IGHV3-33)
ARARYTTGLDY

SEQ ID NO: 24965 - protein, 9 aa, Homo sapiens
  Light chain CDR3 for antibody 12483 (IGKV3D-7)
QQDYNLPYS

SEQ ID NO: 24966 - protein, 15 aa, Homo sapiens
  Heavy chain CDR3 for antibody 12483 (IGHV1-18)
ARGYCSSTSCYYFDY

SEQ ID NO: 24967 - protein, 9 aa, Homo sapiens
  Light chain CDR3 for antibody 12484 (IGKV1-17)
LQHYSYPRT

SEQ ID NO: 24968 - protein, 10 aa, Homo sapiens
  Heavy chain CDR3 for antibody 12484 (IGHV3-33)
VRDVVVYFDY

SEQ ID NO: 24969 - protein, 9 aa, Homo sapiens
  Light chain CDR3 for antibody 12485 (IGKV1D-13)
QQFNNYPYT

SEQ ID NO: 24970 - protein, 12 aa, Homo sapiens
  Heavy chain CDR3 for antibody 12485 (IGHV1-18)
ARKGIEVGGFDY

SEQ ID NO: 24971 - protein, 8 aa, Homo sapiens
  Light chain CDR3 for antibody 12486 (IGKV3-11)
LQRGNWPT

SEQ ID NO: 24972 - protein, 14 aa, Homo sapiens
  Heavy chain CDR3 for antibody 12486 (IGHV3-33)
ARDGYDFLTGPFDY

SEQ ID NO: 24973 - protein, 9 aa, Homo sapiens
  Light chain CDR3 for antibody 12487 (IGKV1D-16)
QQYDNLPFT

SEQ ID NO: 24974 - protein, 14 aa, Homo sapiens
  Heavy chain CDR3 for antibody 12487 (IGHV3-33)
ARRGSPLRPSHLDV

SEQ ID NO: 24975 - protein, 10 aa, Homo sapiens
  Light chain CDR3 for antibody 12488 (IGKV3-20)
QQYGRSPPVT

SEQ ID NO: 24976 - protein, 11 aa, Homo sapiens
  Heavy chain CDR3 for antibody 12488 (IGHV3-23)
AKGLWSYYFDY

SEQ ID NO: 24977 - protein, 9 aa, Homo sapiens
  Light chain CDR3 for antibody 12489 (IGKV1-9)
QQVKSYPYT

SEQ ID NO: 24978 - protein, 15 aa, Homo sapiens
  Heavy chain CDR3 for antibody 12489 (IGHV3-23)
AKDGSYYDYYYGMDV

SEQ ID NO: 24979 - protein, 8 aa, Homo sapiens
  Light chain CDR3 for antibody 12490 (IGKV3-11)
QQRSNWLT

SEQ ID NO: 24980 - protein, 17 aa, Homo sapiens
  Heavy chain CDR3 for antibody 12490 (IGHV3-33)
ARCGYSSSWYDPYYFDY

SEQ ID NO: 24981 - protein, 9 aa, Homo sapiens
  Light chain CDR3 for antibody 12491 (IGKV1D-16)
QQYNSFPLT

SEQ ID NO: 24982 - protein, 16 aa, Homo sapiens
  Heavy chain CDR3 for antibody 12491 (IGHV4-59)
ARYSGSYYGDYYGMDV

SEQ ID NO: 24983 - protein, 9 aa, Homo sapiens
  Light chain CDR3 for antibody 12492 (IGKV1-17)
LQHNSYPPT

SEQ ID NO: 24984 - protein, 18 aa, Homo sapiens
  Heavy chain CDR3 for antibody 12492 (IGHV3-23)
AKDGDYFGSGSYWGYFDL

SEQ ID NO: 24985 - protein, 9 aa, Homo sapiens
  Light chain CDR3 for antibody 12493 (IGKV1-27)
QKYNSAPYT

SEQ ID NO: 24986 - protein, 16 aa, Homo sapiens
  Heavy chain CDR3 for antibody 12493 (IGHV3-33)
ARNWNDVGDYYYGMEV

SEQ ID NO: 24987 - protein, 10 aa, Homo sapiens
  Light chain CDR3 for antibody 12494 (IGKV1-9)
QQLDSYPMYT

SEQ ID NO: 24988 - protein, 21 aa, Homo sapiens
  Heavy chain CDR3 for antibody 12494 (IGHV3-23)
AKDIDYYGSGSYPLYYYGMDV

SEQ ID NO: 24989 - protein, 9 aa, Homo sapiens
  Light chain CDR3 for antibody 12495 (IGKV1-6)
LQDYKSPFT

SEQ ID NO: 24990 - protein, 11 aa, Homo sapiens
  Heavy chain CDR3 for antibody 12495 (IGHV3-23)
ARDPGSITGDY

SEQ ID NO: 24991 - protein, 11 aa, Homo sapiens
  Light chain CDR3 for antibody 12496 (IGKV3-11)
QQRSNWPPTWT

SEQ ID NO: 24992 - protein, 12 aa, Homo sapiens
  Heavy chain CDR3 for antibody 12496 (IGHV3-23)
AKEGLGSDYEPY

SEQ ID NO: 24993 - protein, 10 aa, Homo sapiens
  Light chain CDR3 for antibody 12497 (IGKV3-11)
QQRSTWPTLI

SEQ ID NO: 24994 - protein, 10 aa, Homo sapiens
  Heavy chain CDR3 for antibody 12497 (IGHV3-23)
AKGDRWRFDP

SEQ ID NO: 24995 - protein, 6 aa, Homo sapiens
  Light chain CDR3 for antibody 12498 (IGKV3-20)
QQYGST

SEQ ID NO: 24996 - protein, 13 aa, Homo sapiens
  Heavy chain CDR3 for antibody 12498 (IGHV3-33)
ARDYCGGDCYLDY

SEQ ID NO: 24997 - protein, 9 aa, Homo sapiens
  Light chain CDR3 for antibody 12499 (IGKV1-13)
QQYAGYPPT

SEQ ID NO: 24998 - protein, 13 aa, Homo sapiens
  Heavy chain CDR3 for antibody 12499 (IGHV1-18)
ARSYYGSGSPFDY

SEQ ID NO: 24999 - protein, 10 aa, Homo sapiens
  Light chain CDR3 for antibody 12500 (IGKV3-11)
QQRSNWPALA

SEQ ID NO: 25000 - protein, 14 aa, Homo sapiens
  Heavy chain CDR3 for antibody 12500 (IGHV3-23)
AKSRIVGALYYFDY

SEQ ID NO: 25001 - protein, 9 aa, Homo sapiens
  Light chain CDR3 for antibody 12501 (IGKV1-16)
QQYNSYPYT

SEQ ID NO: 25002 - protein, 13 aa, Homo sapiens
  Heavy chain CDR3 for antibody 12501 (IGHV3-21)
ATGAWASSWWGDY

SEQ ID NO: 25003 - protein, 9 aa, Homo sapiens
  Light chain CDR3 for antibody 12502 (IGKV1-33)
QQYDNLPFT

SEQ ID NO: 25004 - protein, 18 aa, Homo sapiens
  Heavy chain CDR3 for antibody 12502 (IGHV3-23)
AKEGNYYGSGSYWGYFDP

SEQ ID NO: 25005 - protein, 8 aa, Homo sapiens
  Light chain CDR3 for antibody 12503 (IGKV1D-13)
QQFNNYPT

SEQ ID NO: 25006 - protein, 12 aa, Homo sapiens
  Heavy chain CDR3 for antibody 12503 (IGHV3-33)
ARKGYDMHEFDI

SEQ ID NO: 25007 - protein, 7 aa, Homo sapiens
  Light chain CDR3 for antibody 12504 (IGKV1-17)
LQHNSYP

SEQ ID NO: 25008 - protein, 18 aa, Homo sapiens
  Heavy chain CDR3 for antibody 12504 (IGHV3-23)
AKEGNYYGSGSYWGYFDP

SEQ ID NO: 25009 - protein, 8 aa, Homo sapiens
  Light chain CDR3 for antibody 12505 (IGKV3D-7)
QQDYNLLT

SEQ ID NO: 25010 - protein, 14 aa, Homo sapiens
  Heavy chain CDR3 for antibody 12505 (IGHV1-46)
ARKGIVGGFDAFDV

SEQ ID NO: 25011 - protein, 9 aa, Homo sapiens
  Light chain CDR3 for antibody 12506 (IGKV1-39)
QQSYSSPFT

SEQ ID NO: 25012 - protein, 16 aa, Homo sapiens
  Heavy chain CDR3 for antibody 12506 (IGHV3-30)
ARDIAVAGHDYYGMDV

SEQ ID NO: 25013 - protein, 9 aa, Homo sapiens
  Light chain CDR3 for antibody 12507 (IGKV1-6)
LQDYNYPRT

SEQ ID NO: 25014 - protein, 18 aa, Homo sapiens
  Heavy chain CDR3 for antibody 12507 (IGHV3-20)
ARIDVYYYGSGSYRYFDY

SEQ ID NO: 25015 - protein, 9 aa, Homo sapiens
  Light chain CDR3 for antibody 12508 (IGKV1-27)
QKYNSAPYT

SEQ ID NO: 25016 - protein, 15 aa, Homo sapiens
  Heavy chain CDR3 for antibody 12508 (IGHV3-23)
AKAGGRYFDWFPFDY

SEQ ID NO: 25017 - protein, 9 aa, Homo sapiens
  Light chain CDR3 for antibody 12509 (IGKV1-17)
LQHNSYPPT

SEQ ID NO: 25018 - protein, 18 aa, Homo sapiens
  Heavy chain CDR3 for antibody 12509 (IGHV3-33)
ARDPYSSGWYDYYFGMDV

SEQ ID NO: 25019 - protein, 9 aa, Homo sapiens
  Light chain CDR3 for antibody 12510 (IGKV2-30)
MQGTHWPLT

SEQ ID NO: 25020 - protein, 14 aa, Homo sapiens
  Heavy chain CDR3 for antibody 12510 (IGHV1-2)
AREGGSGSSPGMDV

SEQ ID NO: 25021 - protein, 10 aa, Homo sapiens
  Light chain CDR3 for antibody 12511 (IGKV1-39)
QQSYSTPMYT

SEQ ID NO: 25022 - protein, 13 aa, Homo sapiens
  Heavy chain CDR3 for antibody 12511 (IGHV3-11)
AREGIAVAGDFDF

SEQ ID NO: 25023 - protein, 10 aa, Homo sapiens
  Light chain CDR3 for antibody 12512 (IGKV3-15)
QQYNNWPPYT

SEQ ID NO: 25024 - protein, 15 aa, Homo sapiens
  Heavy chain CDR3 for antibody 12512 (IGHV3-33)
ARRICSGGSCSLFDY

SEQ ID NO: 25025 - protein, 9 aa, Homo sapiens
  Light chain CDR3 for antibody 12513 (IGKV1-16)
QHYSDYPFT

SEQ ID NO: 25026 - protein, 13 aa, Homo sapiens
  Heavy chain CDR3 for antibody 12513 (IGHV3-33)
ARDWGYSHGYFDY

SEQ ID NO: 25027 - protein, 9 aa, Homo sapiens
  Light chain CDR3 for antibody 12514 (IGKV5-2)
LQHDKFPYT

SEQ ID NO: 25028 - protein, 12 aa, Homo sapiens
  Heavy chain CDR3 for antibody 12514 (IGHV1-18)
ARILFYGDYLDY

SEQ ID NO: 25029 - protein, 9 aa, Homo sapiens
  Light chain CDR3 for antibody 12515 (IGKV1-6)
QQEYNYPLT

SEQ ID NO: 25030 - protein, 13 aa, Homo sapiens
  Heavy chain CDR3 for antibody 12515 (IGHV4-39)
ARREVVGGRGFDY

SEQ ID NO: 25031 - protein, 9 aa, Homo sapiens
  Light chain CDR3 for antibody 12516 (IGKV5-2)
LQHDKFPYT

SEQ ID NO: 25032 - protein, 16 aa, Homo sapiens
  Heavy chain CDR3 for antibody 12516 (IGHV3-33)
ARAVYYGSGSSRIMDV

SEQ ID NO: 25033 - protein, 9 aa, Homo sapiens
  Light chain CDR3 for antibody 12517 (IGKV5-2)
LQHDNFPWT

SEQ ID NO: 25034 - protein, 18 aa, Homo sapiens
  Heavy chain CDR3 for antibody 12517 (IGHV3-11)
ARDGYFSGWNYYYFGMDV

SEQ ID NO: 25035 - protein, 10 aa, Homo sapiens
  Light chain CDR3 for antibody 12518 (IGKV1-6)
QQSYSTPMYT

SEQ ID NO: 25036 - protein, 14 aa, Homo sapiens
  Heavy chain CDR3 for antibody 12518 (IGHV3-20)
ARDRGSSGHDAFDI

SEQ ID NO: 25037 - protein, 9 aa, Homo sapiens
  Light chain CDR3 for antibody 12519 (IGKV3D-20)
QQYGSSPYT

SEQ ID NO: 25038 - protein, 18 aa, Homo sapiens
  Heavy chain CDR3 for antibody 12519 (IGHV3-33)
ARDHCSGGSCYYYYGMDV

SEQ ID NO: 25039 - protein, 9 aa, Homo sapiens
  Light chain CDR3 for antibody 12520 (IGKV3-15)
QQYNDWPLT

SEQ ID NO: 25040 - protein, 17 aa, Homo sapiens
  Heavy chain CDR3 for antibody 12520 (IGHV1-18)
ARQGVLLWFGELYYFDY

SEQ ID NO: 25041 - protein, 9 aa, Homo sapiens
  Light chain CDR3 for antibody 12521 (IGKV1-27)
QKYNSAPYT

SEQ ID NO: 25042 - protein, 6 aa, Homo sapiens
  Heavy chain CDR3 for antibody 12521 (IGHV1-8)
AREGTY

SEQ ID NO: 25043 - protein, 11 aa, Homo sapiens
  Light chain CDR3 for antibody 12522 (IGKV3-11)
QQRSNWPPMYT

SEQ ID NO: 25044 - protein, 16 aa, Homo sapiens
  Heavy chain CDR3 for antibody 12522 (IGHV4-59)
AREPLRYFDWPDAFDI

SEQ ID NO: 25045 - protein, 11 aa, Homo sapiens
  Light chain CDR3 for antibody 12523 (IGKV3-11)
QQRSNWPPMYT

SEQ ID NO: 25046 - protein, 16 aa, Homo sapiens
  Heavy chain CDR3 for antibody 12523 (IGHV3-33)
ARGYDMLTGDYHCMDV

SEQ ID NO: 25047 - protein, 9 aa, Homo sapiens
  Light chain CDR3 for antibody 12524 (IGKV3-11)
QQRSNWQYT

SEQ ID NO: 25048 - protein, 10 aa, Homo sapiens
  Heavy chain CDR3 for antibody 12524 (IGHV3-13)
ARDRGSYYDY

SEQ ID NO: 25049 - protein, 9 aa, Homo sapiens
  Light chain CDR3 for antibody 12525 (IGKV6-21)
HQSTSLPFT

SEQ ID NO: 25050 - protein, 16 aa, Homo sapiens
  Heavy chain CDR3 for antibody 12525 (IGHV4-59)
ARYSGSYYGDYYGMDV

SEQ ID NO: 25051 - protein, 10 aa, Homo sapiens
  Light chain CDR3 for antibody 12526 (IGKV3-11)
QQRSNWPTWT

SEQ ID NO: 25052 - protein, 11 aa, Homo sapiens
  Heavy chain CDR3 for antibody 12526 (IGHV3-23)
ARDILTGFLDH

SEQ ID NO: 25053 - protein, 7 aa, Homo sapiens
  Light chain CDR3 for antibody 12527 (IGKV3-11)
QQRSKFT

SEQ ID NO: 25054 - protein, 18 aa, Homo sapiens
  Heavy chain CDR3 for antibody 12527 (IGHV3-33)
ARREGIVGATSYYYGMDV

SEQ ID NO: 25055 - protein, 8 aa, Homo sapiens
  Light chain CDR3 for antibody 12528 (IGKV3D-7)
QQDYNLVT

SEQ ID NO: 25056 - protein, 15 aa, Homo sapiens
  Heavy chain CDR3 for antibody 12528 (IGHV4-59)
ARRITMVRGVAPFDY

SEQ ID NO: 25057 - protein, 9 aa, Homo sapiens
  Light chain CDR3 for antibody 12529 (IGKV1-16)
QQYTSYPYT

SEQ ID NO: 25058 - protein, 18 aa, Homo sapiens
  Heavy chain CDR3 for antibody 12529 (IGHV1-46)
ASMVRGVIMAYDYYGMDV

SEQ ID NO: 25059 - protein, 8 aa, Homo sapiens
  Light chain CDR3 for antibody 12530 (IGKV6-21)
HQSSSLPT

SEQ ID NO: 25060 - protein, 11 aa, Homo sapiens
  Heavy chain CDR3 for antibody 12530 (IGHV3-13)
AREAIIGPFDY

SEQ ID NO: 25061 - protein, 10 aa, Homo sapiens
  Light chain CDR3 for antibody 12531 (IGKV1-9)
QQLDSYPMYT

SEQ ID NO: 25062 - protein, 18 aa, Homo sapiens
  Heavy chain CDR3 for antibody 12531 (IGHV3-33)
ARGGVLYDILTGFYCMDV

SEQ ID NO: 25063 - protein, 10 aa, Homo sapiens
  Light chain CDR3 for antibody 12532 (IGKV3-15)
QQYNNWPPLT

SEQ ID NO: 25064 - protein, 9 aa, Homo sapiens
  Heavy chain CDR3 for antibody 12532 (IGHV3-23)
ARIWWLKDY

SEQ ID NO: 25065 - protein, 9 aa, Homo sapiens
  Light chain CDR3 for antibody 12533 (IGKV1-9)
QQLNGYPFT

SEQ ID NO: 25066 - protein, 15 aa, Homo sapiens
  Heavy chain CDR3 for antibody 12533 (IGHV3-20)
ARDRGSSGWRDWFDP

SEQ ID NO: 25067 - protein, 8 aa, Homo sapiens
  Light chain CDR3 for antibody 12534 (IGKV1D-13)
QQFNNYPT

SEQ ID NO: 25068 - protein, 10 aa, Homo sapiens
  Heavy chain CDR3 for antibody 12534 (IGHV3-30)
ARDGLESFDY

SEQ ID NO: 25069 - protein, 9 aa, Homo sapiens
  Light chain CDR3 for antibody 12535 (IGKV5-2)
LQHDKFPYT

SEQ ID NO: 25070 - protein, 22 aa, Homo sapiens
  Heavy chain CDR3 for antibody 12535 (IGHV3-11)
AREAYYDILTGYYTGYYYGMDV

SEQ ID NO: 25071 - protein, 9 aa, Homo sapiens
  Light chain CDR3 for antibody 12536 (IGKV1-33)
QQYDNLPFT

SEQ ID NO: 25072 - protein, 14 aa, Homo sapiens
  Heavy chain CDR3 for antibody 12536 (IGHV3-33)
ARQYSYGYPYYFDY

SEQ ID NO: 25073 - protein, 10 aa, Homo sapiens
  Light chain CDR3 for antibody 12537 (IGKV3-11)
QQRSIWPPYT

SEQ ID NO: 25074 - protein, 13 aa, Homo sapiens
  Heavy chain CDR3 for antibody 12537 (IGHV4-59)
ARDAGYSSSWFDY

SEQ ID NO: 25075 - protein, 9 aa, Homo sapiens
  Light chain CDR3 for antibody 12538 (IGKV1-17)
LQHNSYPYT

SEQ ID NO: 25076 - protein, 13 aa, Homo sapiens
  Heavy chain CDR3 for antibody 12538 (IGHV3-33)
ARIAAAAVQYFQH

SEQ ID NO: 25077 - protein, 8 aa, Homo sapiens
  Light chain CDR3 for antibody 12539 (IGKV3-11)
QQRSNWLT

SEQ ID NO: 25078 - protein, 14 aa, Homo sapiens
  Heavy chain CDR3 for antibody 12539 (IGHV3-33)
AREGYSSNWYDFDY

SEQ ID NO: 25079 - protein, 9 aa, Homo sapiens
  Light chain CDR3 for antibody 12540 (IGKV1-17)
QQLNSYPLT

SEQ ID NO: 25080 - protein, 9 aa, Homo sapiens
  Heavy chain CDR3 for antibody 12540 (IGHV1-18)
ARGKDWFDH

SEQ ID NO: 25081 - protein, 9 aa, Homo sapiens
  Light chain CDR3 for antibody 12541 (IGKV1-39)
QQGFSTPWT

SEQ ID NO: 25082 - protein, 12 aa, Homo sapiens
  Heavy chain CDR3 for antibody 12541 (IGHV3-33)
ARDRAYRGSLAY

SEQ ID NO: 25083 - protein, 8 aa, Homo sapiens
  Light chain CDR3 for antibody 12542 (IGKV3-15)
QQYSNWLT

SEQ ID NO: 25084 - protein, 12 aa, Homo sapiens
  Heavy chain CDR3 for antibody 12542 (IGHV3-33)
ARDRAYRGSLDY

SEQ ID NO: 25085 - protein, 8 aa, Homo sapiens
  Light chain CDR3 for antibody 12543 (IGKV1D-13)
QQFNNYPT

SEQ ID NO: 25086 - protein, 20 aa, Homo sapiens
  Heavy chain CDR3 for antibody 12543 (IGHV3-23)
AKGMGGLRYFDWPHYYGMDV

SEQ ID NO: 25087 - protein, 9 aa, Homo sapiens
  Light chain CDR3 for antibody 12544 (IGKV6-21)
HQSGSLPWT

SEQ ID NO: 25088 - protein, 17 aa, Homo sapiens
  Heavy chain CDR3 for antibody 12544 (IGHV3-23)
AKGDYYGSGTYYAFFDY

SEQ ID NO: 25089 - protein, 9 aa, Homo sapiens
  Light chain CDR3 for antibody 12545 (IGKV1-6)
QQEYNYPLT

SEQ ID NO: 25090 - protein, 17 aa, Homo sapiens
  Heavy chain CDR3 for antibody 12545 (IGHV1-46)
ARGYCSRTSCYLYYFDY

SEQ ID NO: 25091 - protein, 9 aa, Homo sapiens
  Light chain CDR3 for antibody 12546 (IGKV3D-20)
QQYGSGPWT

SEQ ID NO: 25092 - protein, 12 aa, Homo sapiens
  Heavy chain CDR3 for antibody 12546 (IGHV3-33)
ARESGGSYSFDY

SEQ ID NO: 25093 - protein, 9 aa, Homo sapiens
  Light chain CDR3 for antibody 12547 (IGKV1D-13)
QQFNNYPYT

SEQ ID NO: 25094 - protein, 14 aa, Homo sapiens
  Heavy chain CDR3 for antibody 12547 (IGHV3-23)
VRDRIAAASSDFDN

SEQ ID NO: 25095 - protein, 8 aa, Homo sapiens
  Light chain CDR3 for antibody 12548 (IGKV3-15)
QQYNNWPT

SEQ ID NO: 25096 - protein, 14 aa, Homo sapiens
  Heavy chain CDR3 for antibody 12548 (IGHV4-39)
ARQGGSGSYYNLDY

SEQ ID NO: 25097 - protein, 9 aa, Homo sapiens
  Light chain CDR3 for antibody 12549 (IGKV3-15)
QQYNNWPRT

SEQ ID NO: 25098 - protein, 11 aa, Homo sapiens
  Heavy chain CDR3 for antibody 12549 (IGHV3-33)
ARGSGSYAFDY

SEQ ID NO: 25099 - protein, 9 aa, Homo sapiens
  Light chain CDR3 for antibody 12550 (IGKV1D-13)
QHFNNYMYT

SEQ ID NO: 25100 - protein, 13 aa, Homo sapiens
  Heavy chain CDR3 for antibody 12550 (IGHV4-28)
ARKGATGYYGMDV

SEQ ID NO: 25101 - protein, 9 aa, Homo sapiens
  Light chain CDR3 for antibody 12551 (IGKV1D-16)
QQYNSYPYT

SEQ ID NO: 25102 - protein, 15 aa, Homo sapiens
  Heavy chain CDR3 for antibody 12551 (IGHV3-33)
ARDQRYSSGWYDFDY

SEQ ID NO: 25103 - protein, 9 aa, Homo sapiens
  Light chain CDR3 for antibody 12552 (IGKV1D-16)
QQYDSYPPT

SEQ ID NO: 25104 - protein, 17 aa, Homo sapiens
  Heavy chain CDR3 for antibody 12552 (IGHV1-18)
ARERYYGSGSYKYNMDV

SEQ ID NO: 25105 - protein, 9 aa, Homo sapiens
  Light chain CDR3 for antibody 12553 (IGKV1D-13)
QRFNNYLYT

SEQ ID NO: 25106 - protein, 9 aa, Homo sapiens
  Heavy chain CDR3 for antibody 12553 (IGHV4-59)
ARGGASFDY

SEQ ID NO: 25107 - protein, 9 aa, Homo sapiens
  Light chain CDR3 for antibody 12554 (IGKV1-9)
QQYNSYPYT

SEQ ID NO: 25108 - protein, 10 aa, Homo sapiens
  Heavy chain CDR3 for antibody 12554 (IGHV4-59)
ARDWNDAFDI

SEQ ID NO: 25109 - protein, 9 aa, Homo sapiens
  Light chain CDR3 for antibody 12555 (IGKV1-9)
QQLKSYLYT

SEQ ID NO: 25110 - protein, 11 aa, Homo sapiens
  Heavy chain CDR3 for antibody 12555 (IGHV3-33)
AREGAVARFDY

SEQ ID NO: 25111 - protein, 10 aa, Homo sapiens
  Light chain CDR3 for antibody 12556 (IGKV3-11)
QQRSNWLMYT

SEQ ID NO: 25112 - protein, 11 aa, Homo sapiens
  Heavy chain CDR3 for antibody 12556 (IGHV3-33)
ARDILTGFLDH

SEQ ID NO: 25113 - protein, 9 aa, Homo sapiens
  Light chain CDR3 for antibody 12557 (IGKV1-27)
QKYNSAPYT

SEQ ID NO: 25114 - protein, 17 aa, Homo sapiens
  Heavy chain CDR3 for antibody 12557 (IGHV3-13)
AREGWFGELWGYYGMDV

SEQ ID NO: 25115 - protein, 9 aa, Homo sapiens
  Light chain CDR3 for antibody 12558 (IGKV1-17)
LQHNSYPYT

SEQ ID NO: 25116 - protein, 16 aa, Homo sapiens
  Heavy chain CDR3 for antibody 12558 (IGHV4-59)
AGGSGSYRDYYYGIDV

SEQ ID NO: 25117 - protein, 10 aa, Homo sapiens
  Light chain CDR3 for antibody 12559 (IGKV3-15)
QQYNNWPPIT

SEQ ID NO: 25118 - protein, 17 aa, Homo sapiens
  Heavy chain CDR3 for antibody 12559 (IGHV4-59)
ARRITMVREIIITAFDY

SEQ ID NO: 25119 - protein, 9 aa, Homo sapiens
  Light chain CDR3 for antibody 12560 (IGKV1-9)
QQLKSYLYT

SEQ ID NO: 25120 - protein, 19 aa, Homo sapiens
  Heavy chain CDR3 for antibody 12560 (IGHV1-24)
ATAGLQWFGEKIGYYGMDV

SEQ ID NO: 25121 - protein, 8 aa, Homo sapiens
  Light chain CDR3 for antibody 12561 (IGKV1-5)
QQYNSYFT

SEQ ID NO: 25122 - protein, 22 aa, Homo sapiens
  Heavy chain CDR3 for antibody 12561 (IGHV3-30)
ATLPLCGGDCYSAHYRYYGMDV

SEQ ID NO: 25123 - protein, 9 aa, Homo sapiens
  Light chain CDR3 for antibody 12562 (IGKV1-6)
LQDYKSPFT

SEQ ID NO: 25124 - protein, 13 aa, Homo sapiens
  Heavy chain CDR3 for antibody 12562 (IGHV1-2)
ARDGVRGSFGMDV

SEQ ID NO: 25125 - protein, 9 aa, Homo sapiens
  Light chain CDR3 for antibody 12563 (IGKV1-39)
QQSYSTPIT

SEQ ID NO: 25126 - protein, 14 aa, Homo sapiens
  Heavy chain CDR3 for antibody 12563 (IGHV1-46)
ARDQPTVPSGYFDY

SEQ ID NO: 25127 - protein, 9 aa, Homo sapiens
  Light chain CDR3 for antibody 12564 (IGKV1D-13)
QQFNNYPYT

SEQ ID NO: 25128 - protein, 18 aa, Homo sapiens
  Heavy chain CDR3 for antibody 12564 (IGHV3-53)
AKAGDYYVSGSYWGYFDL

SEQ ID NO: 25129 - protein, 9 aa, Homo sapiens
  Light chain CDR3 for antibody 12565 (IGKV1-9)
QKYNSAPYT

SEQ ID NO: 25130 - protein, 14 aa, Homo sapiens
  Heavy chain CDR3 for antibody 12565 (IGHV3-33)
ARDAMGTSTAWFDP

SEQ ID NO: 25131 - protein, 8 aa, Homo sapiens
  Light chain CDR3 for antibody 12566 (IGKV3D-7)
QQDYNLLT

SEQ ID NO: 25132 - protein, 17 aa, Homo sapiens
  Heavy chain CDR3 for antibody 12566 (IGHV3-23)
AKEYCSGGSCYVYYFDY

SEQ ID NO: 25133 - protein, 9 aa, Homo sapiens
  Light chain CDR3 for antibody 12567 (IGKV1-17)
QQYNSYPLT

SEQ ID NO: 25134 - protein, 13 aa, Homo sapiens
  Heavy chain CDR3 for antibody 12567 (IGHV3-33)
ARDYGDYLNWFDP

SEQ ID NO: 25135 - protein, 9 aa, Homo sapiens
  Light chain CDR3 for antibody 12568 (IGKV1-9)
QQLISYPLT

SEQ ID NO: 25136 - protein, 23 aa, Homo sapiens
  Heavy chain CDR3 for antibody 12568 (IGHV3-h)
ARDRGITMVRGVITYYYFYGMDV

SEQ ID NO: 25137 - protein, 9 aa, Homo sapiens
  Light chain CDR3 for antibody 12569 (IGKV2D-28)
MQARQTPPT

SEQ ID NO: 25138 - protein, 10 aa, Homo sapiens
  Heavy chain CDR3 for antibody 12569 (IGHV3-33)
ARENSTPLDY

SEQ ID NO: 25139 - protein, 10 aa, Homo sapiens
  Light chain CDR3 for antibody 12570 (IGKV3-11)
QQRSNWPALT

SEQ ID NO: 25140 - protein, 9 aa, Homo sapiens
  Heavy chain CDR3 for antibody 12570 (IGHV3-33)
ARELAYFDY

SEQ ID NO: 25141 - protein, 8 aa, Homo sapiens
  Light chain CDR3 for antibody 12571 (IGKV6-21)
HQSSSLPT

SEQ ID NO: 25142 - protein, 13 aa, Homo sapiens
  Heavy chain CDR3 for antibody 12571 (IGHV3-21)
ARDSTLVRGVFPY

SEQ ID NO: 25143 - protein, 9 aa, Homo sapiens
  Light chain CDR3 for antibody 12572 (IGKV1-17)
LQHNSYPYT

SEQ ID NO: 25144 - protein, 14 aa, Homo sapiens
  Heavy chain CDR3 for antibody 12572 (IGHV4-39)
ARRGVIVPAAGFDP

SEQ ID NO: 25145 - protein, 9 aa, Homo sapiens
  Light chain CDR3 for antibody 12573 (IGKV3D-7)
QQDYEFPIT

SEQ ID NO: 25146 - protein, 14 aa, Homo sapiens
  Heavy chain CDR3 for antibody 12573 (IGHV4-39)
ARRGVLVPPGGMDV

SEQ ID NO: 25147 - protein, 8 aa, Homo sapiens
  Light chain CDR3 for antibody 12574 (IGKV6-21)
HQSSSLPT

SEQ ID NO: 25148 - protein, 18 aa, Homo sapiens
  Heavy chain CDR3 for antibody 12574 (IGHV3-23)
AKDRITGTTYGYYSGLDV

SEQ ID NO: 25149 - protein, 8 aa, Homo sapiens
  Light chain CDR3 for antibody 12575 (IGKV1D-13)
QQFNNYPT

SEQ ID NO: 25150 - protein, 20 aa, Homo sapiens
  Heavy chain CDR3 for antibody 12575 (IGHV3-33)
ARRMVRGVKKTYYYYYGLDV

SEQ ID NO: 25151 - protein, 9 aa, Homo sapiens
  Light chain CDR3 for antibody 12576 (IGKV1-39)
QQSYSSPFT

SEQ ID NO: 25152 - protein, 14 aa, Homo sapiens
  Heavy chain CDR3 for antibody 12576 (IGHV3-23)
AKSRIVGALYYFGY

SEQ ID NO: 25153 - protein, 9 aa, Homo sapiens
  Light chain CDR3 for antibody 12577 (IGKV1-6)
QQEYNYPLT

SEQ ID NO: 25154 - protein, 14 aa, Homo sapiens
  Heavy chain CDR3 for antibody 12577 (IGHV3-33)
ARDAYDILTGYYDY

SEQ ID NO: 25155 - protein, 9 aa, Homo sapiens
  Light chain CDR3 for antibody 12578 (IGKV3-11)
QQRSNWPYT

SEQ ID NO: 25156 - protein, 16 aa, Homo sapiens
  Heavy chain CDR3 for antibody 12578 (IGHV3-33)
ARDAGYPNYDYYGMDV

SEQ ID NO: 25157 - protein, 10 aa, Homo sapiens
  Light chain CDR3 for antibody 12579 (IGKV3-11)
QQRSNWPMYT

SEQ ID NO: 25158 - protein, 13 aa, Homo sapiens
  Heavy chain CDR3 for antibody 12579 (IGHV3-11)
ARDEGYRGYVLDT

SEQ ID NO: 25159 - protein, 9 aa, Homo sapiens
  Light chain CDR3 for antibody 12580 (IGKV1-39)
QQSYSTPLT

SEQ ID NO: 25160 - protein, 20 aa, Homo sapiens
  Heavy chain CDR3 for antibody 12580 (IGHV1-24)
AAHYDILTGSPYYYYCALDV

SEQ ID NO: 25161 - protein, 9 aa, Homo sapiens
  Light chain CDR3 for antibody 12581 (IGKV3-20)
QLSGSSLLT

SEQ ID NO: 25162 - protein, 14 aa, Homo sapiens
  Heavy chain CDR3 for antibody 12581 (IGHV4-59)
AKGGSGSYYNWFDP

SEQ ID NO: 25163 - protein, 9 aa, Homo sapiens
  Light chain CDR3 for antibody 12582 (IGKV4-1)
QQYYTTPPT

SEQ ID NO: 25164 - protein, 11 aa, Homo sapiens
  Heavy chain CDR3 for antibody 12582 (IGHV3-33)
ARARYTTGLDY

SEQ ID NO: 25165 - protein, 9 aa, Homo sapiens
  Light chain CDR3 for antibody 12583 (IGKV3-20)
QQYGSSPRT

SEQ ID NO: 25166 - protein, 13 aa, Homo sapiens
  Heavy chain CDR3 for antibody 12583 (IGHV4-59)
ARSWFGELLYFDY

SEQ ID NO: 25167 - protein, 10 aa, Homo sapiens
  Light chain CDR3 for antibody 12584 (IGKV1-39)
QQSYSTPMYT

SEQ ID NO: 25168 - protein, 14 aa, Homo sapiens
  Heavy chain CDR3 for antibody 12584 (IGHV3-33)
VRDAMGATPAWFDP

SEQ ID NO: 25169 - protein, 9 aa, Homo sapiens
  Light chain CDR3 for antibody 12585 (IGKV6-21)
HQSSSLPYT

SEQ ID NO: 25170 - protein, 14 aa, Homo sapiens
  Heavy chain CDR3 for antibody 12585 (IGHV3-64)
ARDGLRYFDWLWDY

SEQ ID NO: 25171 - protein, 9 aa, Homo sapiens
  Light chain CDR3 for antibody 12586 (IGKV2-30)
MQGTHWPLT

SEQ ID NO: 25172 - protein, 20 aa, Homo sapiens
  Heavy chain CDR3 for antibody 12586 (IGHV3-11)
AKDRETGTTSYHYYYYGMDV

SEQ ID NO: 25173 - protein, 9 aa, Homo sapiens
  Light chain CDR3 for antibody 12587 (IGKV4-1)
QQYYSTPYT

SEQ ID NO: 25174 - protein, 14 aa, Homo sapiens
  Heavy chain CDR3 for antibody 12587 (IGHV3-33)
ARASSGSSYWYFDL

SEQ ID NO: 25175 - protein, 9 aa, Homo sapiens
  Light chain CDR3 for antibody 12588 (IGKV1-37)
QRTSNAPYT

SEQ ID NO: 25176 - protein, 14 aa, Homo sapiens
  Heavy chain CDR3 for antibody 12588 (IGHV3-33)
ARTTAAAGPRDFQH

SEQ ID NO: 25177 - protein, 9 aa, Homo sapiens
  Light chain CDR3 for antibody 12589 (IGKV4-1)
QQYYSTPWT

SEQ ID NO: 25178 - protein, 19 aa, Homo sapiens
  Heavy chain CDR3 for antibody 12589 (IGHV3-33)
ARDSGYSGYDYYYYYGMDV

SEQ ID NO: 25179 - protein, 8 aa, Homo sapiens
  Light chain CDR3 for antibody 12590 (IGKV1D-13)
QQYNNYPT

SEQ ID NO: 25180 - protein, 17 aa, Homo sapiens
  Heavy chain CDR3 for antibody 12590 (IGHV3-33)
ARSMVTTYGYYYYGMDV

SEQ ID NO: 25181 - protein, 9 aa, Homo sapiens
  Light chain CDR3 for antibody 12591 (IGKV1-17)
LHSNNYPWT

SEQ ID NO: 25182 - protein, 18 aa, Homo sapiens
  Heavy chain CDR3 for antibody 12591 (IGHV1-46)
ARDGDYVWGSYRSDWFDP

SEQ ID NO: 25183 - protein, 9 aa, Homo sapiens
  Light chain CDR3 for antibody 12592 (IGKV3-11)
QQRSNWPRT

SEQ ID NO: 25184 - protein, 17 aa, Homo sapiens
  Heavy chain CDR3 for antibody 12592 (IGHV1-8)
ARGDYYGSGSPYWYFDL

SEQ ID NO: 25185 - protein, 9 aa, Homo sapiens
  Light chain CDR3 for antibody 12593 (IGKV3D-7)
QQDYNLPYT

SEQ ID NO: 25186 - protein, 15 aa, Homo sapiens
  Heavy chain CDR3 for antibody 12593 (IGHV4-39)
ARRSKYSSAWYPFDY

SEQ ID NO: 25187 - protein, 9 aa, Homo sapiens
  Light chain CDR3 for antibody 12594 (IGKV1-6)
LQDYNYPRT

SEQ ID NO: 25188 - protein, 7 aa, Homo sapiens
  Heavy chain CDR3 for antibody 12594 (IGHV3-33)
ARELFDS

SEQ ID NO: 25189 - protein, 9 aa, Homo sapiens
  Light chain CDR3 for antibody 12595 (IGKV3D-7)
QQSYSTPLT

SEQ ID NO: 25190 - protein, 12 aa, Homo sapiens
  Heavy chain CDR3 for antibody 12595 (IGHV3-33)
ARDYGSGSFFDY

SEQ ID NO: 25191 - protein, 9 aa, Homo sapiens
  Light chain CDR3 for antibody 12596 (IGKV1-17)
LQQNSYPWT

SEQ ID NO: 25192 - protein, 15 aa, Homo sapiens
  Heavy chain CDR3 for antibody 12596 (IGHV3-33)
ARDSRPEIIGPPFDY

SEQ ID NO: 25193 - protein, 10 aa, Homo sapiens
  Light chain CDR3 for antibody 12597 (IGKV1-39)
QQSYSTPMYT

SEQ ID NO: 25194 - protein, 15 aa, Homo sapiens
  Heavy chain CDR3 for antibody 12597 (IGHV3-33)
ARDEHYDILTGYWGY

SEQ ID NO: 25195 - protein, 9 aa, Homo sapiens
  Light chain CDR3 for antibody 12598 (IGKV1D-16)
QQYHSYPYT

SEQ ID NO: 25196 - protein, 17 aa, Homo sapiens
  Heavy chain CDR3 for antibody 12598 (IGHV1-18)
ARERYYGSGGYKYNMDD

SEQ ID NO: 25197 - protein, 9 aa, Homo sapiens
  Light chain CDR3 for antibody 12599 (IGKV1-17)
LQLNSFPWT

SEQ ID NO: 25198 - protein, 11 aa, Homo sapiens
  Heavy chain CDR3 for antibody 12599 (IGHV3-33)
ARARYTTGLDY

SEQ ID NO: 25199 - protein, 9 aa, Homo sapiens
  Light chain CDR3 for antibody 12600 (IGKV1-16)
QQYSSYPYT

SEQ ID NO: 25200 - protein, 19 aa, Homo sapiens
  Heavy chain CDR3 for antibody 12600 (IGHV3-33)
ARDSGYSGYDYYYYYGIDV

SEQ ID NO: 25201 - protein, 9 aa, Homo sapiens
  Light chain CDR3 for antibody 12601 (IGKV1-6)
LQDYKSPFT

SEQ ID NO: 25202 - protein, 18 aa, Homo sapiens
  Heavy chain CDR3 for antibody 12601 (IGHV3-33)
ARERGYYGSDIYPAAFDI

SEQ ID NO: 25203 - protein, 9 aa, Homo sapiens
  Light chain CDR3 for antibody 12602 (IGKV2D-28)
MQVLQTPFT

SEQ ID NO: 25204 - protein, 23 aa, Homo sapiens
  Heavy chain CDR3 for antibody 12602 (IGHV4-59)
ARERTYSDILPGYYEDYYYGMDV

SEQ ID NO: 25205 - protein, 9 aa, Homo sapiens
  Light chain CDR3 for antibody 12603 (IGKV2D-28)
MQALQTPRT

SEQ ID NO: 25206 - protein, 12 aa, Homo sapiens
  Heavy chain CDR3 for antibody 12603 (IGHV3-33)
AREGIAVAGVDP

SEQ ID NO: 25207 - protein, 8 aa, Homo sapiens
  Light chain CDR3 for antibody 12604 (IGKV1D-13)
QQFNNYPT

SEQ ID NO: 25208 - protein, 17 aa, Homo sapiens
  Heavy chain CDR3 for antibody 12604 (IGHV3-33)
ARDSYDILTGYYKPFDY

SEQ ID NO: 25209 - protein, 10 aa, Homo sapiens
  Light chain CDR3 for antibody 12605 (IGKV1-39)
QQSYSTPMYT

SEQ ID NO: 25210 - protein, 13 aa, Homo sapiens
  Heavy chain CDR3 for antibody 12605 (IGHV1-46)
ARRQVGYYYGMDV

SEQ ID NO: 25211 - protein, 8 aa, Homo sapiens
  Light chain CDR3 for antibody 12606 (IGKV1-5)
QQYNSYYT

SEQ ID NO: 25212 - protein, 15 aa, Homo sapiens
  Heavy chain CDR3 for antibody 12606 (IGHV3-74)
SRGSGSHYFYYGMDV

SEQ ID NO: 25213 - protein, 9 aa, Homo sapiens
  Light chain CDR3 for antibody 12607 (IGKV1-6)
LQDYNHPFT

SEQ ID NO: 25214 - protein, 17 aa, Homo sapiens
  Heavy chain CDR3 for antibody 12607 (IGHV3-33)
ARVYYDILTGYYWYFDL

SEQ ID NO: 25215 - protein, 9 aa, Homo sapiens
  Light chain CDR3 for antibody 12608 (IGKV3D-7)
KQDYNLPWT

SEQ ID NO: 25216 - protein, 17 aa, Homo sapiens
  Heavy chain CDR3 for antibody 12608 (IGHV1-18)
ARERYYGSGSYKYNMDV

SEQ ID NO: 25217 - protein, 8 aa, Homo sapiens
  Light chain CDR3 for antibody 12609 (IGKV3-20)
QQYGSSLT

SEQ ID NO: 25218 - protein, 10 aa, Homo sapiens
  Heavy chain CDR3 for antibody 12609 (IGHV3-30)
AREWYGGMDV

SEQ ID NO: 25219 - protein, 9 aa, Homo sapiens
  Light chain CDR3 for antibody 12610 (IGKV3-11)
QQRSNWPWT

SEQ ID NO: 25220 - protein, 7 aa, Homo sapiens
  Heavy chain CDR3 for antibody 12610 (IGHV3-33)
ARDYGDY

SEQ ID NO: 25221 - protein, 9 aa, Homo sapiens
  Light chain CDR3 for antibody 12611 (IGKV3D-7)
QQDYNLPYS

SEQ ID NO: 25222 - protein, 15 aa, Homo sapiens
  Heavy chain CDR3 for antibody 12611 (IGHV3-20)
ARDRGSSGWRDWFDP

SEQ ID NO: 25223 - protein, 9 aa, Homo sapiens
  Light chain CDR3 for antibody 12612 (IGKV1D-13)
QQFNNYPYT

SEQ ID NO: 25224 - protein, 15 aa, Homo sapiens
  Heavy chain CDR3 for antibody 12612 (IGHV1-46)
ARGAVDDYYYYGMDV

SEQ ID NO: 25225 - protein, 9 aa, Homo sapiens
  Light chain CDR3 for antibody 12613 (IGKV3-11)
QQRSNWPPT

SEQ ID NO: 25226 - protein, 17 aa, Homo sapiens
  Heavy chain CDR3 for antibody 12613 (IGHV3-33)
TRDSGMVRGIIIYGMDV

SEQ ID NO: 25227 - protein, 9 aa, Homo sapiens
  Light chain CDR3 for antibody 12614 (IGKV3-20)
QQYGSSPYT

SEQ ID NO: 25228 - protein, 12 aa, Homo sapiens
  Heavy chain CDR3 for antibody 12614 (IGHV4-39)
ALDEWPPSWYKY

SEQ ID NO: 25229 - protein, 8 aa, Homo sapiens
  Light chain CDR3 for antibody 12615 (IGKV3-11)
LQRGNWPT

SEQ ID NO: 25230 - protein, 14 aa, Homo sapiens
  Heavy chain CDR3 for antibody 12615 (IGHV3-33)
ARDWNDVYYYGMDV

SEQ ID NO: 25231 - protein, 9 aa, Homo sapiens
  Light chain CDR3 for antibody 12616 (IGKV2-30)
MQGTHWPLT

SEQ ID NO: 25232 - protein, 18 aa, Homo sapiens
  Heavy chain CDR3 for antibody 12616 (IGHV1-8)
AREGAAAGSYYYYNGMDV

SEQ ID NO: 25233 - protein, 9 aa, Homo sapiens
  Light chain CDR3 for antibody 12617 (IGKV2-30)
MQGTHWPLT

SEQ ID NO: 25234 - protein, 17 aa, Homo sapiens
  Heavy chain CDR3 for antibody 12617 (IGHV3-33)
ARVRGVIEGYYYYGMDV

SEQ ID NO: 25235 - protein, 9 aa, Homo sapiens
  Light chain CDR3 for antibody 12618 (IGKV1-9)
QQLKSYTYT

SEQ ID NO: 25236 - protein, 15 aa, Homo sapiens
  Heavy chain CDR3 for antibody 12618 (IGHV3-33)
ARRGYNDYDPYGMDV

SEQ ID NO: 25237 - protein, 9 aa, Homo sapiens
  Light chain CDR3 for antibody 12619 (IGKV3-15)
QQYINWPLT

SEQ ID NO: 25238 - protein, 15 aa, Homo sapiens
  Heavy chain CDR3 for antibody 12619 (IGHV3-23)
AKDRKYDFLTGPFDP

SEQ ID NO: 25239 - protein, 9 aa, Homo sapiens
  Light chain CDR3 for antibody 12620 (IGKV1-17)
LQHNSYPYT

SEQ ID NO: 25240 - protein, 14 aa, Homo sapiens
  Heavy chain CDR3 for antibody 12620 (IGHV3-66)
ARDRDYYYYYGMDV

SEQ ID NO: 25241 - protein, 9 aa, Homo sapiens
  Light chain CDR3 for antibody 12621 (IGKV1-9)
QQVKSYPYT

SEQ ID NO: 25242 - protein, 9 aa, Homo sapiens
  Heavy chain CDR3 for antibody 12621 (IGHV1-46)
ARDNWGFDY

SEQ ID NO: 25243 - protein, 10 aa, Homo sapiens
  Light chain CDR3 for antibody 12622 (IGKV3-20)
QQYGSSPPYT

SEQ ID NO: 25244 - protein, 17 aa, Homo sapiens
  Heavy chain CDR3 for antibody 12622 (IGHV3-33)
ARGFSGYDGYYYYGMDV

SEQ ID NO: 25245 - protein, 9 aa, Homo sapiens
  Light chain CDR3 for antibody 12623 (IGKV1-33)
QKYNSAPYT

SEQ ID NO: 25246 - protein, 24 aa, Homo sapiens
  Heavy chain CDR3 for antibody 12623 (IGHV3-20)
ARGRITMVRGVIIDPLDYYNGMDV

SEQ ID NO: 25247 - protein, 10 aa, Homo sapiens
  Light chain CDR3 for antibody 12624 (IGKV1-17)
QQSYSTPMYT

SEQ ID NO: 25248 - protein, 14 aa, Homo sapiens
  Heavy chain CDR3 for antibody 12624 (IGHV1-24)
ATWLPLYYYYGMDV

SEQ ID NO: 25249 - protein, 9 aa, Homo sapiens
  Light chain CDR3 for antibody 12625 (IGKV1-13)
HQSTSLPFT

SEQ ID NO: 25250 - protein, 14 aa, Homo sapiens
  Heavy chain CDR3 for antibody 12625 (IGHV4-39)
ARHGYDILTGPFDY

SEQ ID NO: 25251 - protein, 9 aa, Homo sapiens
  Light chain CDR3 for antibody 12626 (IGKV1-6)
LQDFHYPWT

SEQ ID NO: 25252 - protein, 13 aa, Homo sapiens
  Heavy chain CDR3 for antibody 12626 (IGHV3-53)
ARSGSYWGYYFDY

SEQ ID NO: 25253 - protein, 9 aa, Homo sapiens
  Light chain CDR3 for antibody 12627 (IGKV1-9)
QQLYTYPYT

SEQ ID NO: 25254 - protein, 15 aa, Homo sapiens
  Heavy chain CDR3 for antibody 12627 (IGHV3-33)
ARDRGSSGWRDWFDP

SEQ ID NO: 25255 - protein, 9 aa, Homo sapiens
  Light chain CDR3 for antibody 12628 (IGKV3-11)
QQRSSWPPT

SEQ ID NO: 25256 - protein, 12 aa, Homo sapiens
  Heavy chain CDR3 for antibody 12628 (IGHV4-59)
ARDRSGWAYFDY

SEQ ID NO: 25257 - protein, 9 aa, Homo sapiens
  Light chain CDR3 for antibody 12629 (IGKV1-9)
QQLNSYPWT

SEQ ID NO: 25258 - protein, 13 aa, Homo sapiens
  Heavy chain CDR3 for antibody 12629 (IGHV1-18)
ARITMVRGVSFDY

SEQ ID NO: 25259 - protein, 9 aa, Homo sapiens
  Light chain CDR3 for antibody 12630 (IGKV3-20)
QQYGTSPFP

SEQ ID NO: 25260 - protein, 14 aa, Homo sapiens
  Heavy chain CDR3 for antibody 12630 (IGHV3-33)
ARDRIAAASSDFDC

SEQ ID NO: 25261 - protein, 9 aa, Homo sapiens
  Light chain CDR3 for antibody 12631 (IGKV1-9)
QQLTSFPRT

SEQ ID NO: 25262 - protein, 12 aa, Homo sapiens
  Heavy chain CDR3 for antibody 12631 (IGHV3-13)
ARDRGYSGYFDY

SEQ ID NO: 25263 - protein, 9 aa, Homo sapiens
  Light chain CDR3 for antibody 12632 (IGKV3-15)
QQYHDWPLT

SEQ ID NO: 25264 - protein, 20 aa, Homo sapiens
  Heavy chain CDR3 for antibody 12632 (IGHV3-11)
ARGGATLIRGLIDYYYGMDV

SEQ ID NO: 25265 - protein, 9 aa, Homo sapiens
  Light chain CDR3 for antibody 12633 (IGKV1-6)
LQDFHYPWT

SEQ ID NO: 25266 - protein, 17 aa, Homo sapiens
  Heavy chain CDR3 for antibody 12633 (IGHV3-33)
ARDLIGPLSSSWYPFDY

SEQ ID NO: 25267 - protein, 10 aa, Homo sapiens
  Light chain CDR3 for antibody 12634 (IGKV1-17)
LQHNSYPMYT

SEQ ID NO: 25268 - protein, 12 aa, Homo sapiens
  Heavy chain CDR3 for antibody 12634 (IGHV3-33)
AREGTGGNWFDP

SEQ ID NO: 25269 - protein, 10 aa, Homo sapiens
  Light chain CDR3 for antibody 12635 (IGKV1-17)
LQHNSYPMYT

SEQ ID NO: 25270 - protein, 10 aa, Homo sapiens
  Heavy chain CDR3 for antibody 12635 (IGHV3-23)
ARDLGWSFDF

SEQ ID NO: 25271 - protein, 10 aa, Homo sapiens
  Light chain CDR3 for antibody 12636 (IGKV3-20)
QQYGSSPPYT

SEQ ID NO: 25272 - protein, 15 aa, Homo sapiens
  Heavy chain CDR3 for antibody 12636 (IGHV3-21)
ARGYYYGSGSFPFDY

SEQ ID NO: 25273 - protein, 9 aa, Homo sapiens
  Light chain CDR3 for antibody 12637 (IGKV2D-24)
TQATQFPHT

SEQ ID NO: 25274 - protein, 12 aa, Homo sapiens
  Heavy chain CDR3 for antibody 12637 (IGHV3-33)
ARDRAYRGSLDY

SEQ ID NO: 25275 - protein, 9 aa, Homo sapiens
  Light chain CDR3 for antibody 12638 (IGKV1-6)
LQDYNYPYT

SEQ ID NO: 25276 - protein, 9 aa, Homo sapiens
  Heavy chain CDR3 for antibody 12638 (IGHV3-74)
ARSEYQPTY

SEQ ID NO: 25277 - protein, 8 aa, Homo sapiens
  Light chain CDR3 for antibody 12639 (IGKV6-21)
HQSSSLPT

SEQ ID NO: 25278 - protein, 17 aa, Homo sapiens
  Heavy chain CDR3 for antibody 12639 (IGHV3-33)
ARDWFGELSDYYYGMDV

SEQ ID NO: 25279 - protein, 9 aa, Homo sapiens
  Light chain CDR3 for antibody 12640 (IGKV3-20)
QQYGSSPYT

SEQ ID NO: 25280 - protein, 19 aa, Homo sapiens
  Heavy chain CDR3 for antibody 12640 (IGHV4-39)
ARQGDVLRYFDWLLGAFDI

SEQ ID NO: 25281 - protein, 10 aa, Homo sapiens
  Light chain CDR3 for antibody 12641 (IGKV1-39)
QQSYSTPMYT

SEQ ID NO: 25282 - protein, 11 aa, Homo sapiens
  Heavy chain CDR3 for antibody 12641 (IGHV4-59)
ARDRGHYGMDV

SEQ ID NO: 25283 - protein, 9 aa, Homo sapiens
  Light chain CDR3 for antibody 12642 (IGKV1-17)
LHSNNYPWT

SEQ ID NO: 25284 - protein, 17 aa, Homo sapiens
  Heavy chain CDR3 for antibody 12642 (IGHV3-33)
ARDSYDILTGYYKPFDY

SEQ ID NO: 25285 - protein, 8 aa, Homo sapiens
  Light chain CDR3 for antibody 12643 (IGKV1-5)
QQYNSYYT

SEQ ID NO: 25286 - protein, 15 aa, Homo sapiens
  Heavy chain CDR3 for antibody 12643 (IGHV4-39)
ARHSGYSSGWYPFDY

SEQ ID NO: 25287 - protein, 9 aa, Homo sapiens
  Light chain CDR3 for antibody 12644 (IGKV1-6)
LQDYIYPRT

SEQ ID NO: 25288 - protein, 15 aa, Homo sapiens
  Heavy chain CDR3 for antibody 12644 (IGHV3-23)
AKDGSYSYYYYGMDV

SEQ ID NO: 25289 - protein, 8 aa, Homo sapiens
  Light chain CDR3 for antibody 12645 (IGKV3D-7)
QQDYNLLT

SEQ ID NO: 25290 - protein, 16 aa, Homo sapiens
  Heavy chain CDR3 for antibody 12645 (IGHV3-33)
AKDAFYYGSGSHLFDY

SEQ ID NO: 25291 - protein, 9 aa, Homo sapiens
  Light chain CDR3 for antibody 12646 (IGKV2D-28)
MQVLQTPFT

SEQ ID NO: 25292 - protein, 10 aa, Homo sapiens
  Heavy chain CDR3 for antibody 12646 (IGHV4-39)
ARQLGNWFDP

SEQ ID NO: 25293 - protein, 10 aa, Homo sapiens
  Light chain CDR3 for antibody 12647 (IGKV3-20)
QQYGRSPPVT

SEQ ID NO: 25294 - protein, 7 aa, Homo sapiens
  Heavy chain CDR3 for antibody 12647 (IGHV1-46)
AREGGDY

SEQ ID NO: 25295 - protein, 9 aa, Homo sapiens
  Light chain CDR3 for antibody 12648 (IGKV1D-16)
QQYNSYPYT

SEQ ID NO: 25296 - protein, 16 aa, Homo sapiens
  Heavy chain CDR3 for antibody 12648 (IGHV3-33)
ARDRIAAAGNFYGLDV

SEQ ID NO: 25297 - protein, 9 aa, Homo sapiens
  Light chain CDR3 for antibody 12649 (IGKV1-6)
LQDYKSPFT

SEQ ID NO: 25298 - protein, 8 aa, Homo sapiens
  Heavy chain CDR3 for antibody 12649 (IGHV3-33)
ARDRGFDY

SEQ ID NO: 25299 - protein, 9 aa, Homo sapiens
  Light chain CDR3 for antibody 12650 (IGKV1-27)
QKYNSAPYT

SEQ ID NO: 25300 - protein, 19 aa, Homo sapiens
  Heavy chain CDR3 for antibody 12650 (IGHV1-18)
ARGGHIGVVTAFHGYGMDV

SEQ ID NO: 25301 - protein, 9 aa, Homo sapiens
  Light chain CDR3 for antibody 12651 (IGKV5-2)
LQHDNFPWT

SEQ ID NO: 25302 - protein, 10 aa, Homo sapiens
  Heavy chain CDR3 for antibody 12651 (IGHV3-72)
CRDREGFGDV

SEQ ID NO: 25303 - protein, 9 aa, Homo sapiens
  Light chain CDR3 for antibody 12652 (IGKV1-6)
LQDYNYPRT

SEQ ID NO: 25304 - protein, 22 aa, Homo sapiens
  Heavy chain CDR3 for antibody 12652 (IGHV1-18)
ARDRYNKQSKYSNRDYYYGLDV

SEQ ID NO: 25305 - protein, 9 aa, Homo sapiens
  Light chain CDR3 for antibody 12653 (IGKV1-39)
QQSYSTPLT

SEQ ID NO: 25306 - protein, 19 aa, Homo sapiens
  Heavy chain CDR3 for antibody 12653 (IGHV3-20)
ARDSAVAGRYYYYYYGMDV

SEQ ID NO: 25307 - protein, 8 aa, Homo sapiens
  Light chain CDR3 for antibody 12654 (IGKV2D-28)
MQALQTPT

SEQ ID NO: 25308 - protein, 17 aa, Homo sapiens
  Heavy chain CDR3 for antibody 12654 (IGHV3-23)
AKDTITMVRGALFGMDV

SEQ ID NO: 25309 - protein, 9 aa, Homo sapiens
  Light chain CDR3 for antibody 12655 (IGKV5-2)
LQHDKFPYT

SEQ ID NO: 25310 - protein, 17 aa, Homo sapiens
  Heavy chain CDR3 for antibody 12655 (IGHV1-24)
TTVVLYYDILPGYSFDY

SEQ ID NO: 25311 - protein, 9 aa, Homo sapiens
  Light chain CDR3 for antibody 12656 (IGKV1-16)
QQYHSYPYT

SEQ ID NO: 25312 - protein, 9 aa, Homo sapiens
  Heavy chain CDR3 for antibody 12656 (IGHV4-59)
AREGGSGGL

SEQ ID NO: 25313 - protein, 9 aa, Homo sapiens
  Light chain CDR3 for antibody 12657 (IGKV2-30)
MQGTHWPLT

SEQ ID NO: 25314 - protein, 16 aa, Homo sapiens
  Heavy chain CDR3 for antibody 12657 (IGHV3-11)
ARDSELRYFDWFGMDV

SEQ ID NO: 25315 - protein, 9 aa, Homo sapiens
  Light chain CDR3 for antibody 12658 (IGKV1-39)
QQSYSTPLT

SEQ ID NO: 25316 - protein, 12 aa, Homo sapiens
  Heavy chain CDR3 for antibody 12658 (IGHV3-33)
ARDPGYFFGLDV

SEQ ID NO: 25317 - protein, 9 aa, Homo sapiens
  Light chain CDR3 for antibody 12659 (IGKV1-6)
LQDYNYPPT

SEQ ID NO: 25318 - protein, 16 aa, Homo sapiens
  Heavy chain CDR3 for antibody 12659 (IGHV3-33)
ARDLVGATTYYYGMDV

SEQ ID NO: 25319 - protein, 10 aa, Homo sapiens
  Light chain CDR3 for antibody 12660 (IGKV1-17)
LQHNSYPMYT

SEQ ID NO: 25320 - protein, 17 aa, Homo sapiens
  Heavy chain CDR3 for antibody 12660 (IGHV3-23)
AKDYDILTGYSHNWFDP

SEQ ID NO: 25321 - protein, 8 aa, Homo sapiens
  Light chain CDR3 for antibody 12661 (IGKV1-5)
QQYNSYWT

SEQ ID NO: 25322 - protein, 12 aa, Homo sapiens
  Heavy chain CDR3 for antibody 12661 (IGHV3-33)
ASRDILTGYLGY

SEQ ID NO: 25323 - protein, 8 aa, Homo sapiens
  Light chain CDR3 for antibody 12662 (IGKV1D-13)
QQFNNYPT

SEQ ID NO: 25324 - protein, 13 aa, Homo sapiens
  Heavy chain CDR3 for antibody 12662 (IGHV3-33)
ARCIVAAMGGFDY

SEQ ID NO: 25325 - protein, 9 aa, Homo sapiens
  Light chain CDR3 for antibody 12663 (IGKV1D-16)
QQYNSNPLT

SEQ ID NO: 25326 - protein, 19 aa, Homo sapiens
  Heavy chain CDR3 for antibody 12663 (IGHV4-59)
ARGRGSYYYGPGSHNGMDV

SEQ ID NO: 25327 - protein, 9 aa, Homo sapiens
  Light chain CDR3 for antibody 12664 (IGKV2-30)
MQGTHWPLT

SEQ ID NO: 25328 - protein, 15 aa, Homo sapiens
  Heavy chain CDR3 for antibody 12664 (IGHV3-23)
AKDLSSGWYAYFFDY

SEQ ID NO: 25329 - protein, 9 aa, Homo sapiens
  Light chain CDR3 for antibody 12665 (IGKV1-9)
QQLNSYPLT

SEQ ID NO: 25330 - protein, 17 aa, Homo sapiens
  Heavy chain CDR3 for antibody 12665 (IGHV3-33)
ARQGVLLWSGELYYFDY

SEQ ID NO: 25331 - protein, 10 aa, Homo sapiens
  Light chain CDR3 for antibody 12666 (IGKV3-11)
QQRSNWPIFT

SEQ ID NO: 25332 - protein, 19 aa, Homo sapiens
  Heavy chain CDR3 for antibody 12666 (IGHV1-24)
ATAGLQWFGEKIGYYGMDV

SEQ ID NO: 25333 - protein, 8 aa, Homo sapiens
  Light chain CDR3 for antibody 12667 (IGKV3-11)
QQRSNWLT

SEQ ID NO: 25334 - protein, 10 aa, Homo sapiens
  Heavy chain CDR3 for antibody 12667 (IGHV3-33)
ARDGSGSQPI

SEQ ID NO: 25335 - protein, 8 aa, Homo sapiens
  Light chain CDR3 for antibody 12668 (IGKV2D-28)
MQALQTPT

SEQ ID NO: 25336 - protein, 18 aa, Homo sapiens
  Heavy chain CDR3 for antibody 12668 (IGHV4-59)
AREGHYYTSGSYYKAFDY

SEQ ID NO: 25337 - protein, 9 aa, Homo sapiens
  Light chain CDR3 for antibody 12669 (IGKV1-6)
LQDYNYPYT

SEQ ID NO: 25338 - protein, 15 aa, Homo sapiens
  Heavy chain CDR3 for antibody 12669 (IGHV3-23)
AKDENYYDYYYGMDV

SEQ ID NO: 25339 - protein, 9 aa, Homo sapiens
  Light chain CDR3 for antibody 12670 (IGKV3D-7)
QQDYNLPLT

SEQ ID NO: 25340 - protein, 11 aa, Homo sapiens
  Heavy chain CDR3 for antibody 12670 (IGHV3-33)
ARDRGYSYFDY

SEQ ID NO: 25341 - protein, 9 aa, Homo sapiens
  Light chain CDR3 for antibody 12671 (IGKV1D-16)
QQYYSYPRT

SEQ ID NO: 25342 - protein, 13 aa, Homo sapiens
  Heavy chain CDR3 for antibody 12671 (IGHV4-39)
ARHEVMVRGVFDY

SEQ ID NO: 25343 - protein, 9 aa, Homo sapiens
  Light chain CDR3 for antibody 12672 (IGKV1-9)
QQFNSYTRT

SEQ ID NO: 25344 - protein, 13 aa, Homo sapiens
  Heavy chain CDR3 for antibody 12672 (IGHV3-33)
ARDYCGGDCYLDY

SEQ ID NO: 25345 - protein, 8 aa, Homo sapiens
  Light chain CDR3 for antibody 12673 (IGKV3D-7)
QQDYNLLT

SEQ ID NO: 25346 - protein, 17 aa, Homo sapiens
  Heavy chain CDR3 for antibody 12673 (IGHV3-23)
ANGGFGESHYNYYCMDV

SEQ ID NO: 25347 - protein, 8 aa, Homo sapiens
  Light chain CDR3 for antibody 12674 (IGKV1-5)
QQYNSYYT

SEQ ID NO: 25348 - protein, 18 aa, Homo sapiens
  Heavy chain CDR3 for antibody 12674 (IGHV3-33)
ARDEYYGSGIYYNYGMDV

SEQ ID NO: 25349 - protein, 9 aa, Homo sapiens
  Light chain CDR3 for antibody 12675 (IGKV1-6)
LQDFHYPWT

SEQ ID NO: 25350 - protein, 14 aa, Homo sapiens
  Heavy chain CDR3 for antibody 12675 (IGHV1-46)
ARDGVGAKEGGSDY

SEQ ID NO: 25351 - protein, 9 aa, Homo sapiens
  Light chain CDR3 for antibody 12676 (IGKV1-39)
QQSYSTPFT

SEQ ID NO: 25352 - protein, 17 aa, Homo sapiens
  Heavy chain CDR3 for antibody 12676 (IGHV4-61)
ARNTMVGTWQRQGNLDH

SEQ ID NO: 25353 - protein, 9 aa, Homo sapiens
  Light chain CDR3 for antibody 12677 (IGKV1-27)
QKYNSAPHT

SEQ ID NO: 25354 - protein, 8 aa, Homo sapiens
  Heavy chain CDR3 for antibody 12677 (IGHV3-33)
ARDRGFDY

SEQ ID NO: 25355 - protein, 10 aa, Homo sapiens
  Light chain CDR3 for antibody 12678 (IGKV3-11)
QQRSNWPIFT

SEQ ID NO: 25356 - protein, 18 aa, Homo sapiens
  Heavy chain CDR3 for antibody 12678 (IGHV4-59)
ARERGNWNDVDYYYGMDV

SEQ ID NO: 25357 - protein, 9 aa, Homo sapiens
  Light chain CDR3 for antibody 12679 (IGKV1-39)
QQSYRTPLT

SEQ ID NO: 25358 - protein, 13 aa, Homo sapiens
  Heavy chain CDR3 for antibody 12679 (IGHV4-39)
ARRDGSYYGYFDY

SEQ ID NO: 25359 - protein, 10 aa, Homo sapiens
  Light chain CDR3 for antibody 12680 (IGKV1-17)
LQHNSYPIYT

SEQ ID NO: 25360 - protein, 16 aa, Homo sapiens
  Heavy chain CDR3 for antibody 12680 (IGHV3-20)
ARDSSSLDYYYYGMDV

SEQ ID NO: 25361 - protein, 9 aa, Homo sapiens
  Light chain CDR3 for antibody 12681 (IGKV3-15)
QQYDNLPFT

SEQ ID NO: 25362 - protein, 11 aa, Homo sapiens
  Heavy chain CDR3 for antibody 12681 (IGHV3-23)
GEFSSGWSFDY

SEQ ID NO: 25363 - protein, 9 aa, Homo sapiens
  Light chain CDR3 for antibody 12682 (IGKV1-6)
LQDYNYPYT

SEQ ID NO: 25364 - protein, 14 aa, Homo sapiens
  Heavy chain CDR3 for antibody 12682 (IGHV3-66)
ARDRDYYYYYGMDV

SEQ ID NO: 25365 - protein, 9 aa, Homo sapiens
  Light chain CDR3 for antibody 12683 (IGKV6-21)
HQSSSLPWT

SEQ ID NO: 25366 - protein, 16 aa, Homo sapiens
  Heavy chain CDR3 for antibody 12683 (IGHV3-33)
ARDQGILTGYYTAFDY

SEQ ID NO: 25367 - protein, 9 aa, Homo sapiens
  Light chain CDR3 for antibody 12684 (IGKV3-11)
QHRGNWPLT

SEQ ID NO: 25368 - protein, 18 aa, Homo sapiens
  Heavy chain CDR3 for antibody 12684 (IGHV4-34)
AREGHYYTSGSYYKAFDY

SEQ ID NO: 25369 - protein, 9 aa, Homo sapiens
  Light chain CDR3 for antibody 12685 (IGKV1-39)
QQSYSTPFT

SEQ ID NO: 25370 - protein, 14 aa, Homo sapiens
  Heavy chain CDR3 for antibody 12685 (IGHV3-33)
ARDWNDVYYYAMDV

SEQ ID NO: 25371 - protein, 9 aa, Homo sapiens
  Light chain CDR3 for antibody 12686 (IGKV2D-28)
MQALQTPPT

SEQ ID NO: 25372 - protein, 18 aa, Homo sapiens
  Heavy chain CDR3 for antibody 12686 (IGHV3-23)
ARYHLYFGSGFGSDGMDV

SEQ ID NO: 25373 - protein, 9 aa, Homo sapiens
  Light chain CDR3 for antibody 12687 (IGKV3D-20)
QQHGTSPLT

SEQ ID NO: 25374 - protein, 14 aa, Homo sapiens
  Heavy chain CDR3 for antibody 12687 (IGHV1-18)
ARCFGSGSYGWFDP

SEQ ID NO: 25375 - protein, 10 aa, Homo sapiens
  Light chain CDR3 for antibody 12688 (IGKV3-15)
QQYNNWPPLT

SEQ ID NO: 25376 - protein, 11 aa, Homo sapiens
  Heavy chain CDR3 for antibody 12688 (IGHV4-39)
AREAYYYGLDV

SEQ ID NO: 25377 - protein, 10 aa, Homo sapiens
  Light chain CDR3 for antibody 12689 (IGKV3-11)
QQRSNWPALA

SEQ ID NO: 25378 - protein, 14 aa, Homo sapiens
  Heavy chain CDR3 for antibody 12689 (IGHV3-33)
ARDNILTGYYLFDY

SEQ ID NO: 25379 - protein, 10 aa, Homo sapiens
  Light chain CDR3 for antibody 12690 (IGKV1-27)
QKYNSAPMYT

SEQ ID NO: 25380 - protein, 17 aa, Homo sapiens
  Heavy chain CDR3 for antibody 12690 (IGHV4-39)
ARVLRYFDWLSHDAFDI

SEQ ID NO: 25381 - protein, 10 aa, Homo sapiens
  Light chain CDR3 for antibody 12691 (IGKV3-11)
QQRSTWPTLI

SEQ ID NO: 25382 - protein, 18 aa, Homo sapiens
  Heavy chain CDR3 for antibody 12691 (IGHV6-1)
ARDQYSYGPYYYYYGMDV

SEQ ID NO: 25383 - protein, 9 aa, Homo sapiens
  Light chain CDR3 for antibody 12692 (IGKV1-6)
QQEYNYPLT

SEQ ID NO: 25384 - protein, 10 aa, Homo sapiens
  Heavy chain CDR3 for antibody 12692 (IGHV1-18)
AREQRLGFDY

SEQ ID NO: 25385 - protein, 9 aa, Homo sapiens
  Light chain CDR3 for antibody 12693 (IGKV1-17)
QQYGSSPYT

SEQ ID NO: 25386 - protein, 9 aa, Homo sapiens
  Heavy chain CDR3 for antibody 12693 (IGHV3-33)
ARGPYYDIL

SEQ ID NO: 25387 - protein, 9 aa, Homo sapiens
  Light chain CDR3 for antibody 12694 (IGKV3D-7)
QQDYNLPLT

SEQ ID NO: 25388 - protein, 12 aa, Homo sapiens
  Heavy chain CDR3 for antibody 12694 (IGHV3-23)
AKESLYSPTDDY

SEQ ID NO: 25389 - protein, 8 aa, Homo sapiens
  Light chain CDR3 for antibody 12695 (IGKV3-11)
QQRSNWLT

SEQ ID NO: 25390 - protein, 14 aa, Homo sapiens
  Heavy chain CDR3 for antibody 12695 (IGHV4-39)
ARQGTMIRGGYFDY

SEQ ID NO: 25391 - protein, 8 aa, Homo sapiens
  Light chain CDR3 for antibody 12696 (IGKV1D-13)
QQYNSYYT

SEQ ID NO: 25392 - protein, 20 aa, Homo sapiens
  Heavy chain CDR3 for antibody 12696 (IGHV1-f)
ATHYDILTGSPYYYYCALDV

SEQ ID NO: 25393 - protein, 9 aa, Homo sapiens
  Light chain CDR3 for antibody 12697 (IGKV1-6)
LQDFHYPWT

SEQ ID NO: 25394 - protein, 14 aa, Homo sapiens
  Heavy chain CDR3 for antibody 12697 (IGHV3-21)
ARGGYSGYRYYFDY

SEQ ID NO: 25395 - protein, 9 aa, Homo sapiens
  Light chain CDR3 for antibody 12698 (IGKV1-6)
QQGNTYSRT

SEQ ID NO: 25396 - protein, 17 aa, Homo sapiens
  Heavy chain CDR3 for antibody 12698 (IGHV4-34)
AGLRFFDWLFDYYGMDV

SEQ ID NO: 25397 - protein, 9 aa, Homo sapiens
  Light chain CDR3 for antibody 12699 (IGKV5-2)
LQHDNFPWT

SEQ ID NO: 25398 - protein, 18 aa, Homo sapiens
  Heavy chain CDR3 for antibody 12699 (IGHV3-33)
ARGYYGSGNFYKDSGRDV

SEQ ID NO: 25399 - protein, 9 aa, Homo sapiens
  Light chain CDR3 for antibody 12700 (IGKV5-2)
LQHDKFPYT

SEQ ID NO: 25400 - protein, 13 aa, Homo sapiens
  Heavy chain CDR3 for antibody 12700 (IGHV4-59)
ARDAGYSSSWLDY

SEQ ID NO: 25401 - protein, 10 aa, Homo sapiens
  Light chain CDR3 for antibody 12701 (IGKV1-39)
QQSYSTPMYT

SEQ ID NO: 25402 - protein, 19 aa, Homo sapiens
  Heavy chain CDR3 for antibody 12701 (IGHV3-33)
TRDPHYDILTGYAYYGMDV

SEQ ID NO: 25403 - protein, 10 aa, Homo sapiens
  Light chain CDR3 for antibody 12702 (IGKV3-15)
QQYNNWPPYT

SEQ ID NO: 25404 - protein, 18 aa, Homo sapiens
  Heavy chain CDR3 for antibody 12702 (IGHV3-33)
ARDRDRYGSGTYPDAIAI

SEQ ID NO: 25405 - protein, 11 aa, Homo sapiens
  Light chain CDR3 for antibody 12703 (IGKV3-11)
QQRSNWPPTWT

SEQ ID NO: 25406 - protein, 17 aa, Homo sapiens
  Heavy chain CDR3 for antibody 12703 (IGHV1-24)
ATEGYDILPGYYNVLDY

SEQ ID NO: 25407 - protein, 9 aa, Homo sapiens
  Light chain CDR3 for antibody 12704 (IGKV1-9)
QQLISYPLT

SEQ ID NO: 25408 - protein, 11 aa, Homo sapiens
  Heavy chain CDR3 for antibody 12704 (IGHV3-33)
ARDGIAAVFDY

SEQ ID NO: 25409 - protein, 8 aa, Homo sapiens
  Light chain CDR3 for antibody 12705 (IGKV2D-28)
MQALQTPT

SEQ ID NO: 25410 - protein, 15 aa, Homo sapiens
  Heavy chain CDR3 for antibody 12705 (IGHV3-20)
ARDRGSSGWRDWFDP

SEQ ID NO: 25411 - protein, 9 aa, Homo sapiens
  Light chain CDR3 for antibody 12706 (IGKV3-11)
QQRSNWMYT

SEQ ID NO: 25412 - protein, 20 aa, Homo sapiens
  Heavy chain CDR3 for antibody 12706 (IGHV3-33)
SRGGATLVRGVIDYYYGMDV

SEQ ID NO: 25413 - protein, 9 aa, Homo sapiens
  Light chain CDR3 for antibody 12707 (IGKV1-5)
QQYNTYSRT

SEQ ID NO: 25414 - protein, 12 aa, Homo sapiens
  Heavy chain CDR3 for antibody 12707 (IGHV3-74)
ARDLVGATPFDY

SEQ ID NO: 25415 - protein, 9 aa, Homo sapiens
  Light chain CDR3 for antibody 12708 (IGKV1-6)
LQDYNYPWT

SEQ ID NO: 25416 - protein, 16 aa, Homo sapiens
  Heavy chain CDR3 for antibody 12708 (IGHV3-33)
ARGDGDILTGFYGMDV

SEQ ID NO: 25417 - protein, 7 aa, Homo sapiens
  Light chain CDR3 for antibody 12709 (IGKV1-17)
LQHNSYP

SEQ ID NO: 25418 - protein, 13 aa, Homo sapiens
  Heavy chain CDR3 for antibody 12709 (IGHV3-33)
ARQWPSGYWYFDL

SEQ ID NO: 25419 - protein, 9 aa, Homo sapiens
  Light chain CDR3 for antibody 12710 (IGKV1-6)
LQDYNSPWT

SEQ ID NO: 25420 - protein, 14 aa, Homo sapiens
  Heavy chain CDR3 for antibody 12710 (IGHV3-33)
ARAVSGSSYWYFDL

SEQ ID NO: 25421 - protein, 9 aa, Homo sapiens
  Light chain CDR3 for antibody 12711 (IGKV1-33)
QQYDNLPFT

SEQ ID NO: 25422 - protein, 14 aa, Homo sapiens
  Heavy chain CDR3 for antibody 12711 (IGHV3-33)
ARDRNYDILNGGGY

SEQ ID NO: 25423 - protein, 10 aa, Homo sapiens
  Light chain CDR3 for antibody 12712 (IGKV1-27)
QKYNSAPMYT

SEQ ID NO: 25424 - protein, 13 aa, Homo sapiens
  Heavy chain CDR3 for antibody 12712 (IGHV1-18)
ARSITMVRGVIGY

SEQ ID NO: 25425 - protein, 9 aa, Homo sapiens
  Light chain CDR3 for antibody 12713 (IGKV1-9)
QQLNGYPFT

SEQ ID NO: 25426 - protein, 11 aa, Homo sapiens
  Heavy chain CDR3 for antibody 12713 (IGHV4-59)
ARDRGHYGMDV

SEQ ID NO: 25427 - protein, 10 aa, Homo sapiens
  Light chain CDR3 for antibody 12714 (IGKV1-17)
LQHNSYPIFT

SEQ ID NO: 25428 - protein, 14 aa, Homo sapiens
  Heavy chain CDR3 for antibody 12714 (IGHV4-39)
ARDSGYDYYYGMDV

SEQ ID NO: 25429 - protein, 9 aa, Homo sapiens
  Light chain CDR3 for antibody 12715 (IGKV3-11)
QQRSDWPLT

SEQ ID NO: 25430 - protein, 16 aa, Homo sapiens
  Heavy chain CDR3 for antibody 12715 (IGHV3-20)
ARDSSSLDYYYYGMDV

SEQ ID NO: 25431 - protein, 9 aa, Homo sapiens
  Light chain CDR3 for antibody 12716 (IGKV1-9)
QQLKSYLYT

SEQ ID NO: 25432 - protein, 12 aa, Homo sapiens
  Heavy chain CDR3 for antibody 12716 (IGHV3-33)
AREGDILTGYSL

SEQ ID NO: 25433 - protein, 9 aa, Homo sapiens
  Light chain CDR3 for antibody 12717 (IGKV1-16)
LQDYNYPWT

SEQ ID NO: 25434 - protein, 16 aa, Homo sapiens
  Heavy chain CDR3 for antibody 12717 (IGHV3-23)
AKDVGLAAAGSGWFDP

SEQ ID NO: 25435 - protein, 11 aa, Homo sapiens
  Light chain CDR3 for antibody 12718 (IGKV3-11)
QQRSNWPPTWT

SEQ ID NO: 25436 - protein, 18 aa, Homo sapiens
  Heavy chain CDR3 for antibody 12718 (IGHV3-33)
ARERGYYGSDIYPAAFDI

SEQ ID NO: 25437 - protein, 9 aa, Homo sapiens
  Light chain CDR3 for antibody 12719 (IGKV1D-16)
QQYDSYPYT

SEQ ID NO: 25438 - protein, 11 aa, Homo sapiens
  Heavy chain CDR3 for antibody 12719 (IGHV3-33)
ARDGIAAVFDY

SEQ ID NO: 25439 - protein, 9 aa, Homo sapiens
  Light chain CDR3 for antibody 12720 (IGKV3-11)
QQRSNWMYT

SEQ ID NO: 25440 - protein, 11 aa, Homo sapiens
  Heavy chain CDR3 for antibody 12720 (IGHV4-39)
ARLLVGATTDY

SEQ ID NO: 25441 - protein, 9 aa, Homo sapiens
  Light chain CDR3 for antibody 12721 (IGKV5-2)
LQHDKFPYT

SEQ ID NO: 25442 - protein, 12 aa, Homo sapiens
  Heavy chain CDR3 for antibody 12721 (IGHV3-33)
ARDGRAAAYFDN

SEQ ID NO: 25443 - protein, 7 aa, Homo sapiens
  Light chain CDR3 for antibody 12722 (IGKV1-17)
LQHNSYP

SEQ ID NO: 25444 - protein, 16 aa, Homo sapiens
  Heavy chain CDR3 for antibody 12722 (IGHV3-23)
AKEGMVLRYFDWLWDY

SEQ ID NO: 25445 - protein, 10 aa, Homo sapiens
  Light chain CDR3 for antibody 12723 (IGKV1-17)
LQHNSYPMYT

SEQ ID NO: 25446 - protein, 18 aa, Homo sapiens
  Heavy chain CDR3 for antibody 12723 (IGHV3-33)
ARDRYYDILTGYYMGFDY

SEQ ID NO: 25447 - protein, 9 aa, Homo sapiens
  Light chain CDR3 for antibody 12724 (IGKV3-15)
QQYINWPLT

SEQ ID NO: 25448 - protein, 20 aa, Homo sapiens
  Heavy chain CDR3 for antibody 12724 (IGHV3-33)
AREDYYGSGSYYPAYNWFDP

SEQ ID NO: 25449 - protein, 9 aa, Homo sapiens
  Light chain CDR3 for antibody 12725 (IGKV3-11)
QQRSNWMYT

SEQ ID NO: 25450 - protein, 12 aa, Homo sapiens
  Heavy chain CDR3 for antibody 12725 (IGHV4-39)
ARHGSGSSYFDY

SEQ ID NO: 25451 - protein, 9 aa, Homo sapiens
  Light chain CDR3 for antibody 12726 (IGKV1D-16)
QQYNSYPYT

SEQ ID NO: 25452 - protein, 17 aa, Homo sapiens
  Heavy chain CDR3 for antibody 12726 (IGHV1-18)
ARDRYYGSGNYKYHMDV

SEQ ID NO: 25453 - protein, 9 aa, Homo sapiens
  Light chain CDR3 for antibody 12727 (IGKV3D-7)
QQDYDLPYP

SEQ ID NO: 25454 - protein, 14 aa, Homo sapiens
  Heavy chain CDR3 for antibody 12727 (IGHV4-39)
ARQDYDILTGLFDY

SEQ ID NO: 25455 - protein, 9 aa, Homo sapiens
  Light chain CDR3 for antibody 12728 (IGKV1-27)
QKYNSAPYT

SEQ ID NO: 25456 - protein, 17 aa, Homo sapiens
  Heavy chain CDR3 for antibody 12728 (IGHV3-33)
ARGGGYEDDHYYYGMDV

SEQ ID NO: 25457 - protein, 9 aa, Homo sapiens
  Light chain CDR3 for antibody 12729 (IGKV1-27)
QKYNSAPWT

SEQ ID NO: 25458 - protein, 13 aa, Homo sapiens
  Heavy chain CDR3 for antibody 12729 (IGHV1-18)
ARSYYGSGSPFDY

SEQ ID NO: 25459 - protein, 10 aa, Homo sapiens
  Light chain CDR3 for antibody 12730 (IGKV3-11)
QQRSNWPILT

SEQ ID NO: 25460 - protein, 16 aa, Homo sapiens
  Heavy chain CDR3 for antibody 12730 (IGHV4-59)
ARFYFGSGSYYWYFDL

SEQ ID NO: 25461 - protein, 10 aa, Homo sapiens
  Light chain CDR3 for antibody 12731 (IGKV1-39)
QKYNSAPMYT

SEQ ID NO: 25462 - protein, 21 aa, Homo sapiens
  Heavy chain CDR3 for antibody 12731 (IGHV3-33)
ARKRLYDILTGYYKAYYGMDV

SEQ ID NO: 25463 - protein, 9 aa, Homo sapiens
  Light chain CDR3 for antibody 12732 (IGKV3-11)
QQRINWPWT

SEQ ID NO: 25464 - protein, 13 aa, Homo sapiens
  Heavy chain CDR3 for antibody 12732 (IGHV3-33)
ARDWGYSHGYFDY

SEQ ID NO: 25465 - protein, 9 aa, Homo sapiens
  Light chain CDR3 for antibody 12733 (IGKV3-15)
QQYNNWPRT

SEQ ID NO: 25466 - protein, 17 aa, Homo sapiens
  Heavy chain CDR3 for antibody 12733 (IGHV3-33)
AREGTMVRGYYYYGMDV

SEQ ID NO: 25467 - protein, 9 aa, Homo sapiens
  Light chain CDR3 for antibody 12734 (IGKV1D-16)
QQYITYPYT

SEQ ID NO: 25468 - protein, 14 aa, Homo sapiens
  Heavy chain CDR3 for antibody 12734 (IGHV3-33)
ARKGYSGRYYYFDY

SEQ ID NO: 25469 - protein, 9 aa, Homo sapiens
  Light chain CDR3 for antibody 12735 (IGKV1-6)
LQQNSYPWT

SEQ ID NO: 25470 - protein, 12 aa, Homo sapiens
  Heavy chain CDR3 for antibody 12735 (IGHV4-59)
ARDSGSYYFFDY

SEQ ID NO: 25471 - protein, 9 aa, Homo sapiens
  Light chain CDR3 for antibody 12736 (IGKV1-27)
QKYNSAPYT

SEQ ID NO: 25472 - protein, 18 aa, Homo sapiens
  Heavy chain CDR3 for antibody 12736 (IGHV3-33)
ARGYYGSGNFYKHSGMDV

SEQ ID NO: 25473 - protein, 10 aa, Homo sapiens
  Light chain CDR3 for antibody 12737 (IGKV3-11)
QQRSNWPALT

SEQ ID NO: 25474 - protein, 11 aa, Homo sapiens
  Heavy chain CDR3 for antibody 12737 (IGHV3-33)
ARDQGGSSFDY

SEQ ID NO: 25475 - protein, 9 aa, Homo sapiens
  Light chain CDR3 for antibody 12738 (IGKV3-15)
QQYNNWPYT

SEQ ID NO: 25476 - protein, 20 aa, Homo sapiens
  Heavy chain CDR3 for antibody 12738 (IGHV3-33)
ARDPAQLERRYYYFYYGMDV

SEQ ID NO: 25477 - protein, 9 aa, Homo sapiens
  Light chain CDR3 for antibody 12739 (IGKV5-2)
LQHDKFPYT

SEQ ID NO: 25478 - protein, 11 aa, Homo sapiens
  Heavy chain CDR3 for antibody 12739 (IGHV1-24)
ATREYSSSCDY

SEQ ID NO: 25479 - protein, 9 aa, Homo sapiens
  Light chain CDR3 for antibody 12740 (IGKV1-39)
QQGFSTPWT

SEQ ID NO: 25480 - protein, 10 aa, Homo sapiens
  Heavy chain CDR3 for antibody 12740 (IGHV4-59)
AKGDRWRFDP

SEQ ID NO: 25481 - protein, 9 aa, Homo sapiens
  Light chain CDR3 for antibody 12741 (IGKV1-17)
LQHTSYPFT

SEQ ID NO: 25482 - protein, 17 aa, Homo sapiens
  Heavy chain CDR3 for antibody 12741 (IGHV1-18)
ARERYYGSGSYKYNMDV

SEQ ID NO: 25483 - protein, 9 aa, Homo sapiens
  Light chain CDR3 for antibody 12742 (IGKV1-5)
QQYNTYSRT

SEQ ID NO: 25484 - protein, 20 aa, Homo sapiens
  Heavy chain CDR3 for antibody 12742 (IGHV3-33)
SRGGATLVRGVIDYYYGMDV

SEQ ID NO: 25485 - protein, 9 aa, Homo sapiens
  Light chain CDR3 for antibody 12743 (IGKV2-30)
MQGTHWPLT

SEQ ID NO: 25486 - protein, 17 aa, Homo sapiens
  Heavy chain CDR3 for antibody 12743 (IGHV3-33)
ARENDILTGSYYYGMDV

SEQ ID NO: 25487 - protein, 9 aa, Homo sapiens
  Light chain CDR3 for antibody 12744 (IGKV1-9)
QQLKSYLYT

SEQ ID NO: 25488 - protein, 12 aa, Homo sapiens
  Heavy chain CDR3 for antibody 12744 (IGHV3-23)
AKDGWFGESLDY

SEQ ID NO: 25489 - protein, 10 aa, Homo sapiens
  Light chain CDR3 for antibody 12745 (IGKV1-27)
QKYNSAPMYT

SEQ ID NO: 25490 - protein, 14 aa, Homo sapiens
  Heavy chain CDR3 for antibody 12745 (IGHV3-66)
ARDNILTAYYLFDY

SEQ ID NO: 25491 - protein, 9 aa, Homo sapiens
  Light chain CDR3 for antibody 12746 (IGKV1-9)
QQLTSFPRT

SEQ ID NO: 25492 - protein, 15 aa, Homo sapiens
  Heavy chain CDR3 for antibody 12746 (IGHV3-33)
ARDRGWKAPGYGMDV

SEQ ID NO: 25493 - protein, 10 aa, Homo sapiens
  Light chain CDR3 for antibody 12747 (IGKV1-17)
LQHNSYPMYT

SEQ ID NO: 25494 - protein, 17 aa, Homo sapiens
  Heavy chain CDR3 for antibody 12747 (IGHV4-59)
ARDFLVRGEGSYYGMDV

SEQ ID NO: 25495 - protein, 10 aa, Homo sapiens
  Light chain CDR3 for antibody 12748 (IGKV1-27)
QKYNSAPMYT

SEQ ID NO: 25496 - protein, 18 aa, Homo sapiens
  Heavy chain CDR3 for antibody 12748 (IGHV6-1)
ARDQYSYGPYYYYYGMDV

SEQ ID NO: 25497 - protein, 8 aa, Homo sapiens
  Light chain CDR3 for antibody 12749 (IGKV3D-7)
QQDYNLLT

SEQ ID NO: 25498 - protein, 16 aa, Homo sapiens
  Heavy chain CDR3 for antibody 12749 (IGHV3-33)
ARAYYYGSGSYPHFQH

SEQ ID NO: 25499 - protein, 9 aa, Homo sapiens
  Light chain CDR3 for antibody 12750 (IGKV3D-20)
QQYGRSPYT

SEQ ID NO: 25500 - protein, 19 aa, Homo sapiens
  Heavy chain CDR3 for antibody 12750 (IGHV3-33)
ARGGVVRGVIEYYYYGMDV

SEQ ID NO: 25501 - protein, 9 aa, Homo sapiens
  Light chain CDR3 for antibody 12751 (IGKV1-17)
LHSNNYPWT

SEQ ID NO: 25502 - protein, 12 aa, Homo sapiens
  Heavy chain CDR3 for antibody 12751 (IGHV3-33)
ARDSSGWSHFDY

SEQ ID NO: 25503 - protein, 9 aa, Homo sapiens
  Light chain CDR3 for antibody 12752 (IGKV1-16)
QQYNSYPLT

SEQ ID NO: 25504 - protein, 4 aa, Homo sapiens
  Heavy chain CDR3 for antibody 12752 (IGHV3-30)
ARDN

SEQ ID NO: 25505 - protein, 9 aa, Homo sapiens
  Light chain CDR3 for antibody 12753 (IGKV1-6)
LQHNSYPYT

SEQ ID NO: 25506 - protein, 15 aa, Homo sapiens
  Heavy chain CDR3 for antibody 12753 (IGHV1-18)
ARGSYDSSGYYYFDY

SEQ ID NO: 25507 - protein, 9 aa, Homo sapiens
  Light chain CDR3 for antibody 12754 (IGKV1-5)
LQYDSYPWT

SEQ ID NO: 25508 - protein, 13 aa, Homo sapiens
  Heavy chain CDR3 for antibody 12754 (IGHV4-39)
ARHEVMIRGVFDY

SEQ ID NO: 25509 - protein, 9 aa, Homo sapiens
  Light chain CDR3 for antibody 12755 (IGKV3-11)
QHRGNWPLT

SEQ ID NO: 25510 - protein, 16 aa, Homo sapiens
  Heavy chain CDR3 for antibody 12755 (IGHV3-23)
AKEGMVLRYFDWLWDY

SEQ ID NO: 25511 - protein, 10 aa, Homo sapiens
  Light chain CDR3 for antibody 12756 (IGKV3-15)
QQYNKWPPYT

SEQ ID NO: 25512 - protein, 20 aa, Homo sapiens
  Heavy chain CDR3 for antibody 12756 (IGHV1-f)
ATGLITFVRGVILTYRSFDY

SEQ ID NO: 25513 - protein, 9 aa, Homo sapiens
  Light chain CDR3 for antibody 12757 (IGKV1-33)
QQYDNLPFT

SEQ ID NO: 25514 - protein, 15 aa, Homo sapiens
  Heavy chain CDR3 for antibody 12757 (IGHV3-33)
ARRGYNDYDPYGMDV

SEQ ID NO: 25515 - protein, 10 aa, Homo sapiens
  Light chain CDR3 for antibody 12758 (IGKV3-20)
QQYGSSPPYT

SEQ ID NO: 25516 - protein, 12 aa, Homo sapiens
  Heavy chain CDR3 for antibody 12758 (IGHV3-33)
ARDRAYRGSLDY

SEQ ID NO: 25517 - protein, 10 aa, Homo sapiens
  Light chain CDR3 for antibody 12759 (IGKV1-9)
QQLNSFLMYT

SEQ ID NO: 25518 - protein, 13 aa, Homo sapiens
  Heavy chain CDR3 for antibody 12759 (IGHV4-28)
ARKGATGYYGMDV

SEQ ID NO: 25519 - protein, 11 aa, Homo sapiens
  Light chain CDR3 for antibody 12760 (IGKV3-11)
QQRSNWPPTWT

SEQ ID NO: 25520 - protein, 16 aa, Homo sapiens
  Heavy chain CDR3 for antibody 12760 (IGHV1-46)
ARGGGYSESYSNWFDP

SEQ ID NO: 25521 - protein, 9 aa, Homo sapiens
  Light chain CDR3 for antibody 12761 (IGKV6-21)
HQSYSLPHT

SEQ ID NO: 25522 - protein, 20 aa, Homo sapiens
  Heavy chain CDR3 for antibody 12761 (IGHV3-33)
ARDICSSTSCYGYYYYGMDV

SEQ ID NO: 25523 - protein, 9 aa, Homo sapiens
  Light chain CDR3 for antibody 12762 (IGKV1-17)
LHSNNYPWT

SEQ ID NO: 25524 - protein, 15 aa, Homo sapiens
  Heavy chain CDR3 for antibody 12762 (IGHV3-33)
ARDHLTGYYYYGMDV

SEQ ID NO: 25525 - protein, 9 aa, Homo sapiens
  Light chain CDR3 for antibody 12763 (IGKV5-2)
LQHDKFPYT

SEQ ID NO: 25526 - protein, 18 aa, Homo sapiens
  Heavy chain CDR3 for antibody 12763 (IGHV3-33)
VRERGHYGSGSFPDAFDI

SEQ ID NO: 25527 - protein, 9 aa, Homo sapiens
  Light chain CDR3 for antibody 12764 (IGKV1-27)
QKYNSAPYT

SEQ ID NO: 25528 - protein, 14 aa, Homo sapiens
  Heavy chain CDR3 for antibody 12764 (IGHV3-64)
ARGGGAVTGTNFDY

SEQ ID NO: 25529 - protein, 9 aa, Homo sapiens
  Light chain CDR3 for antibody 12765 (IGKV1-17)
LQHNSYPWT

SEQ ID NO: 25530 - protein, 9 aa, Homo sapiens
  Heavy chain CDR3 for antibody 12765 (IGHV3-23)
AIGRYYFDY

SEQ ID NO: 25531 - protein, 9 aa, Homo sapiens
  Light chain CDR3 for antibody 12766 (IGKV1D-16)
QQYNSYPPT

SEQ ID NO: 25532 - protein, 12 aa, Homo sapiens
  Heavy chain CDR3 for antibody 12766 (IGHV3-11)
VRVLLWFGESDY

SEQ ID NO: 25533 - protein, 8 aa, Homo sapiens
  Light chain CDR3 for antibody 12767 (IGKV6-21)
HQSSSLPT

SEQ ID NO: 25534 - protein, 18 aa, Homo sapiens
  Heavy chain CDR3 for antibody 12767 (IGHV3-33)
ARGYYGSGNFYKDSGMDV

SEQ ID NO: 25535 - protein, 9 aa, Homo sapiens
  Light chain CDR3 for antibody 12768 (IGKV1-6)
LQDFHYPWT

SEQ ID NO: 25536 - protein, 13 aa, Homo sapiens
  Heavy chain CDR3 for antibody 12768 (IGHV3-23)
ARAFFMVRGVIDF

SEQ ID NO: 25537 - protein, 10 aa, Homo sapiens
  Light chain CDR3 for antibody 12769 (IGKV1-17)
QKYNSAPMYT

SEQ ID NO: 25538 - protein, 14 aa, Homo sapiens
  Heavy chain CDR3 for antibody 12769 (IGHV3-33)
ARDGYDFLTGPFDY

SEQ ID NO: 25539 - protein, 10 aa, Homo sapiens
  Light chain CDR3 for antibody 12770 (IGKV3-11)
QQRSNWPIFT

SEQ ID NO: 25540 - protein, 9 aa, Homo sapiens
  Heavy chain CDR3 for antibody 12770 (IGHV3-33)
AREYKEFDY

SEQ ID NO: 25541 - protein, 9 aa, Homo sapiens
  Light chain CDR3 for antibody 12771 (IGKV2-30)
MQGTHWPYT

SEQ ID NO: 25542 - protein, 13 aa, Homo sapiens
  Heavy chain CDR3 for antibody 12771 (IGHV4-39)
ARRDVLAPAAFDY

SEQ ID NO: 25543 - protein, 9 aa, Homo sapiens
  Light chain CDR3 for antibody 12772 (IGKV3-15)
QQYNNWPRT

SEQ ID NO: 25544 - protein, 16 aa, Homo sapiens
  Heavy chain CDR3 for antibody 12772 (IGHV4-59)
ARFYFGSGSYYWYFDL

SEQ ID NO: 25545 - protein, 9 aa, Homo sapiens
  Light chain CDR3 for antibody 12773 (IGKV2-30)
AQGSYWPAS

SEQ ID NO: 25546 - protein, 13 aa, Homo sapiens
  Heavy chain CDR3 for antibody 12773 (IGHV3-33)
AKEDGDYHHYFDY

SEQ ID NO: 25547 - protein, 9 aa, Homo sapiens
  Light chain CDR3 for antibody 12774 (IGKV1-33)
QQYDNLPFT

SEQ ID NO: 25548 - protein, 9 aa, Homo sapiens
  Heavy chain CDR3 for antibody 12774 (IGHV3-30)
ARDYFHYDY

SEQ ID NO: 25549 - protein, 10 aa, Homo sapiens
  Light chain CDR3 for antibody 12775 (IGKV1-17)
LQHNSYPMYT

SEQ ID NO: 25550 - protein, 12 aa, Homo sapiens
  Heavy chain CDR3 for antibody 12775 (IGHV3-23)
ARQGYDMHEFDI

SEQ ID NO: 25551 - protein, 9 aa, Homo sapiens
  Light chain CDR3 for antibody 12776 (IGKV1-6)
LQDFHYPWT

SEQ ID NO: 25552 - protein, 11 aa, Homo sapiens
  Heavy chain CDR3 for antibody 12776 (IGHV3-74)
ARDRGNWGFDY

SEQ ID NO: 25553 - protein, 9 aa, Homo sapiens
  Light chain CDR3 for antibody 12777 (IGKV3-15)
QQYNNWPRT

SEQ ID NO: 25554 - protein, 12 aa, Homo sapiens
  Heavy chain CDR3 for antibody 12777 (IGHV3-33)
AREGIAVAGVDP

SEQ ID NO: 25555 - protein, 9 aa, Homo sapiens
  Light chain CDR3 for antibody 12778 (IGKV2D-24)
TQATQFPHT

SEQ ID NO: 25556 - protein, 16 aa, Homo sapiens
  Heavy chain CDR3 for antibody 12778 (IGHV1-24)
ATEDSSSYYYYYGMDV

SEQ ID NO: 25557 - protein, 9 aa, Homo sapiens
  Light chain CDR3 for antibody 12779 (IGKV1-16)
QQYNSYPYT

SEQ ID NO: 25558 - protein, 16 aa, Homo sapiens
  Heavy chain CDR3 for antibody 12779 (IGHV3-33)
ARDGSMVRRIHDAFDF

SEQ ID NO: 25559 - protein, 9 aa, Homo sapiens
  Light chain CDR3 for antibody 12780 (IGKV3D-20)
QQYGSSPRT

SEQ ID NO: 25560 - protein, 17 aa, Homo sapiens
  Heavy chain CDR3 for antibody 12780 (IGHV3-23)
AKDRDWKDGYYYFGMDV

SEQ ID NO: 25561 - protein, 10 aa, Homo sapiens
  Light chain CDR3 for antibody 12781 (IGKV1-6)
LQDYNYPMYT

SEQ ID NO: 25562 - protein, 12 aa, Homo sapiens
  Heavy chain CDR3 for antibody 12781 (IGHV1-46)
ARGLTGDHAVDI

SEQ ID NO: 25563 - protein, 9 aa, Homo sapiens
  Light chain CDR3 for antibody 12782 (IGKV1-39)
QQSYRTPLT

SEQ ID NO: 25564 - protein, 16 aa, Homo sapiens
  Heavy chain CDR3 for antibody 12782 (IGHV4-59)
AREGYNWNDGVNWFDP

SEQ ID NO: 25565 - protein, 9 aa, Homo sapiens
  Light chain CDR3 for antibody 12783 (IGKV1-9)
QQGNTYSRT

SEQ ID NO: 25566 - protein, 15 aa, Homo sapiens
  Heavy chain CDR3 for antibody 12783 (IGHV3-30)
ARDSRPEIIGPPFDY

SEQ ID NO: 25567 - protein, 9 aa, Homo sapiens
  Light chain CDR3 for antibody 12784 (IGKV1-33)
QQYDNLPFT

SEQ ID NO: 25568 - protein, 11 aa, Homo sapiens
  Heavy chain CDR3 for antibody 12784 (IGHV3-33)
ARAGIAAVFDY

SEQ ID NO: 25569 - protein, 9 aa, Homo sapiens
  Light chain CDR3 for antibody 12785 (IGKV5-2)
LQHDNSPYT

SEQ ID NO: 25570 - protein, 10 aa, Homo sapiens
  Heavy chain CDR3 for antibody 12785 (IGHV3-33)
ARDHGWCFDY

SEQ ID NO: 25571 - protein, 8 aa, Homo sapiens
  Light chain CDR3 for antibody 12786 (IGKV3-20)
QQYGSSLT

SEQ ID NO: 25572 - protein, 20 aa, Homo sapiens
  Heavy chain CDR3 for antibody 12786 (IGHV3-33)
AKGMGGLRYFDWPHYYGMDV

SEQ ID NO: 25573 - protein, 9 aa, Homo sapiens
  Light chain CDR3 for antibody 12787 (IGKV1-6)
LQDYKSPFT

SEQ ID NO: 25574 - protein, 10 aa, Homo sapiens
  Heavy chain CDR3 for antibody 12787 (IGHV3-23)
AKENWNDFDY

SEQ ID NO: 25575 - protein, 10 aa, Homo sapiens
  Light chain CDR3 for antibody 12788 (IGKV1-9)
QQLDSYPMYT

SEQ ID NO: 25576 - protein, 18 aa, Homo sapiens
  Heavy chain CDR3 for antibody 12788 (IGHV4-39)
ARQYYFGSGNYYRGWFDP

SEQ ID NO: 25577 - protein, 9 aa, Homo sapiens
  Light chain CDR3 for antibody 12789 (IGKV1-33)
QQYDNLPFT

SEQ ID NO: 25578 - protein, 8 aa, Homo sapiens
  Heavy chain CDR3 for antibody 12789 (IGHV3-23)
EKSAGEDV

SEQ ID NO: 25579 - protein, 9 aa, Homo sapiens
  Light chain CDR3 for antibody 12790 (IGKV1-39)
QQSYSTPYT

SEQ ID NO: 25580 - protein, 15 aa, Homo sapiens
  Heavy chain CDR3 for antibody 12790 (IGHV4-39)
ARHSKYSSGWYPFDY

SEQ ID NO: 25581 - protein, 9 aa, Homo sapiens
  Light chain CDR3 for antibody 12791 (IGKV1-9)
QQLHIYPWT

SEQ ID NO: 25582 - protein, 16 aa, Homo sapiens
  Heavy chain CDR3 for antibody 12791 (IGHV4-59)
ARGRYFEWLLGDVFDI

SEQ ID NO: 25583 - protein, 8 aa, Homo sapiens
  Light chain CDR3 for antibody 12792 (IGKV3-11)
LQRGNWPT

SEQ ID NO: 25584 - protein, 18 aa, Homo sapiens
  Heavy chain CDR3 for antibody 12792 (IGHV4-59)
AREGHYYTSGSYYKAFDY

SEQ ID NO: 25585 - protein, 9 aa, Homo sapiens
  Light chain CDR3 for antibody 12793 (IGKV1-27)
QKYNSAPYT

SEQ ID NO: 25586 - protein, 15 aa, Homo sapiens
  Heavy chain CDR3 for antibody 12793 (IGHV3-33)
ARRGYNDYDPYGMDV

SEQ ID NO: 25587 - protein, 9 aa, Homo sapiens
  Light chain CDR3 for antibody 12794 (IGKV1-9)
QQLNSYPYT

SEQ ID NO: 25588 - protein, 9 aa, Homo sapiens
  Heavy chain CDR3 for antibody 12794 (IGHV3-33)
ASHSSGEDY

SEQ ID NO: 25589 - protein, 9 aa, Homo sapiens
  Light chain CDR3 for antibody 12795 (IGKV2D-24)
TQATQFPHT

SEQ ID NO: 25590 - protein, 15 aa, Homo sapiens
  Heavy chain CDR3 for antibody 12795 (IGHV1-2)
ARDLGYYGSGSRMDV

SEQ ID NO: 25591 - protein, 9 aa, Homo sapiens
  Light chain CDR3 for antibody 12796 (IGKV1-9)
QQLKSYPYT

SEQ ID NO: 25592 - protein, 14 aa, Homo sapiens
  Heavy chain CDR3 for antibody 12796 (IGHV3-20)
ARDEGSGGYDVFDI

SEQ ID NO: 25593 - protein, 9 aa, Homo sapiens
  Light chain CDR3 for antibody 12797 (IGKV1-6)
LQDYNYPWT

SEQ ID NO: 25594 - protein, 13 aa, Homo sapiens
  Heavy chain CDR3 for antibody 12797 (IGHV3-33)
ARDQRYSSGWCDY

SEQ ID NO: 25595 - protein, 9 aa, Homo sapiens
  Light chain CDR3 for antibody 12798 (IGKV1-17)
LHSNNYPWT

SEQ ID NO: 25596 - protein, 15 aa, Homo sapiens
  Heavy chain CDR3 for antibody 12798 (IGHV3-23)
AKDGSYYDYYYGMDV

SEQ ID NO: 25597 - protein, 8 aa, Homo sapiens
  Light chain CDR3 for antibody 12799 (IGKV3D-7)
QQDYHLLT

SEQ ID NO: 25598 - protein, 17 aa, Homo sapiens
  Heavy chain CDR3 for antibody 12799 (IGHV4-34)
ARDGSGSYTHYYYCMDV

SEQ ID NO: 25599 - protein, 8 aa, Homo sapiens
  Light chain CDR3 for antibody 12800 (IGKV3-11)
LQRGNWPT

SEQ ID NO: 25600 - protein, 17 aa, Homo sapiens
  Heavy chain CDR3 for antibody 12800 (IGHV3-23)
AKDGIGELSYYYYGMDV

SEQ ID NO: 25601 - protein, 10 aa, Homo sapiens
  Light chain CDR3 for antibody 12801 (IGKV3-11)
QQRSNWPIWT

SEQ ID NO: 25602 - protein, 9 aa, Homo sapiens
  Heavy chain CDR3 for antibody 12801 (IGHV3-23)
ARGRLDFDY

SEQ ID NO: 25603 - protein, 9 aa, Homo sapiens
  Light chain CDR3 for antibody 12802 (IGKV4-1)
QQYYSYPLT

SEQ ID NO: 25604 - protein, 11 aa, Homo sapiens
  Heavy chain CDR3 for antibody 12802 (IGHV1-46)
AREQHGQAPDY

SEQ ID NO: 25605 - protein, 10 aa, Homo sapiens
  Light chain CDR3 for antibody 12803 (IGKV1-39)
QQSYSTPMYT

SEQ ID NO: 25606 - protein, 17 aa, Homo sapiens
  Heavy chain CDR3 for antibody 12803 (IGHV4-34)
AGLRFFDWLFDYYGMDV

SEQ ID NO: 25607 - protein, 9 aa, Homo sapiens
  Light chain CDR3 for antibody 12804 (IGKV1-17)
LQHYSYPRT

SEQ ID NO: 25608 - protein, 15 aa, Homo sapiens
  Heavy chain CDR3 for antibody 12804 (IGHV3-33)
ARDSRPEIIGPPFDY

SEQ ID NO: 25609 - protein, 9 aa, Homo sapiens
  Light chain CDR3 for antibody 12805 (IGKV1D-13)
QQFNNYPHT

SEQ ID NO: 25610 - protein, 12 aa, Homo sapiens
  Heavy chain CDR3 for antibody 12805 (IGHV1-18)
ARRDGSGTSFDY

SEQ ID NO: 25611 - protein, 10 aa, Homo sapiens
  Light chain CDR3 for antibody 12806 (IGKV3-20)
QQYGRSPPVT

SEQ ID NO: 25612 - protein, 10 aa, Homo sapiens
  Heavy chain CDR3 for antibody 12806 (IGHV3-33)
ARDVVVYFDY

SEQ ID NO: 25613 - protein, 8 aa, Homo sapiens
  Light chain CDR3 for antibody 12807 (IGKV3-20)
QQYGSSRT

SEQ ID NO: 25614 - protein, 12 aa, Homo sapiens
  Heavy chain CDR3 for antibody 12807 (IGHV1-18)
ARVLFYGDYFDY

SEQ ID NO: 25615 - protein, 10 aa, Homo sapiens
  Light chain CDR3 for antibody 12808 (IGKV1-39)
QQSYSTPMYT

SEQ ID NO: 25616 - protein, 8 aa, Homo sapiens
  Heavy chain CDR3 for antibody 12808 (IGHV3-23)
EKSAGEDV

SEQ ID NO: 25617 - protein, 9 aa, Homo sapiens
  Light chain CDR3 for antibody 12809 (IGKV1-9)
QQLHIYPWT

SEQ ID NO: 25618 - protein, 11 aa, Homo sapiens
  Heavy chain CDR3 for antibody 12809 (IGHV3-33)
AREAANWGFDY

SEQ ID NO: 25619 - protein, 9 aa, Homo sapiens
  Light chain CDR3 for antibody 12810 (IGKV1-9)
QQLISYPLT

SEQ ID NO: 25620 - protein, 16 aa, Homo sapiens
  Heavy chain CDR3 for antibody 12810 (IGHV3-33)
AREVGAKDYYYYGMDV

SEQ ID NO: 25621 - protein, 8 aa, Homo sapiens
  Light chain CDR3 for antibody 12811 (IGKV1-39)
QQSYSTLT

SEQ ID NO: 25622 - protein, 17 aa, Homo sapiens
  Heavy chain CDR3 for antibody 12811 (IGHV3-33)
ARDRDDYGDYYYYGMDV

SEQ ID NO: 25623 - protein, 10 aa, Homo sapiens
  Light chain CDR3 for antibody 12812 (IGKV1-27)
QKYNSAPMYT

SEQ ID NO: 25624 - protein, 17 aa, Homo sapiens
  Heavy chain CDR3 for antibody 12812 (IGHV4-34)
AGLRFFDWLFDYYGMDV

SEQ ID NO: 25625 - protein, 9 aa, Homo sapiens
  Light chain CDR3 for antibody 12813 (IGKV6-21)
HQSTSLPHT

SEQ ID NO: 25626 - protein, 15 aa, Homo sapiens
  Heavy chain CDR3 for antibody 12813 (IGHV4-39)
ARRSKYSSAWYPFDY

SEQ ID NO: 25627 - protein, 9 aa, Homo sapiens
  Light chain CDR3 for antibody 12814 (IGKV1-9)
QQYNSYPYT

SEQ ID NO: 25628 - protein, 18 aa, Homo sapiens
  Heavy chain CDR3 for antibody 12814 (IGHV1-8)
ARGRYNSGWNYYYFGMDV

SEQ ID NO: 25629 - protein, 9 aa, Homo sapiens
  Light chain CDR3 for antibody 12815 (IGKV1-6)
LQDYNHPFT

SEQ ID NO: 25630 - protein, 11 aa, Homo sapiens
  Heavy chain CDR3 for antibody 12815 (IGHV3-33)
ARGTTVTHFEY

SEQ ID NO: 25631 - protein, 9 aa, Homo sapiens
  Light chain CDR3 for antibody 12816 (IGKV1-6)
LQDFHYPWT

SEQ ID NO: 25632 - protein, 21 aa, Homo sapiens
  Heavy chain CDR3 for antibody 12816 (IGHV3-33)
ARDEYYEIVTGYGYYHYGMDV

SEQ ID NO: 25633 - protein, 9 aa, Homo sapiens
  Light chain CDR3 for antibody 12817 (IGKV3D-7)
QQDYEFPLT

SEQ ID NO: 25634 - protein, 19 aa, Homo sapiens
  Heavy chain CDR3 for antibody 12817 (IGHV3-33)
ARGVRLRYFDPYYYYGMDV

SEQ ID NO: 25635 - protein, 9 aa, Homo sapiens
  Light chain CDR3 for antibody 12818 (IGKV1-17)
LQHNSYPWT

SEQ ID NO: 25636 - protein, 14 aa, Homo sapiens
  Heavy chain CDR3 for antibody 12818 (IGHV3-33)
ARDHYDSGSYFLDY

SEQ ID NO: 25637 - protein, 9 aa, Homo sapiens
  Light chain CDR3 for antibody 12819 (IGKV1-17)
LQHNSYPLT

SEQ ID NO: 25638 - protein, 18 aa, Homo sapiens
  Heavy chain CDR3 for antibody 12819 (IGHV3-33)
ARREGIVGTTTYYYGMDV

SEQ ID NO: 25639 - protein, 9 aa, Homo sapiens
  Light chain CDR3 for antibody 12820 (IGKV1-6)
LQVYSYPWT

SEQ ID NO: 25640 - protein, 13 aa, Homo sapiens
  Heavy chain CDR3 for antibody 12820 (IGHV3-33)
ARDWGYSHGYFDY

SEQ ID NO: 25641 - protein, 10 aa, Homo sapiens
  Light chain CDR3 for antibody 12821 (IGKV3-11)
QQRSNWPALT

SEQ ID NO: 25642 - protein, 15 aa, Homo sapiens
  Heavy chain CDR3 for antibody 12821 (IGHV3-33)
AREGLRYFHYYGMDV

SEQ ID NO: 25643 - protein, 9 aa, Homo sapiens
  Light chain CDR3 for antibody 12822 (IGKV3D-7)
QQDYNLPYT

SEQ ID NO: 25644 - protein, 17 aa, Homo sapiens
  Heavy chain CDR3 for antibody 12822 (IGHV1-18)
ARERYYGSGSYKYNMDV

SEQ ID NO: 25645 - protein, 10 aa, Homo sapiens
  Light chain CDR3 for antibody 12823 (IGKV1-27)
QKYNSAPMYT

SEQ ID NO: 25646 - protein, 15 aa, Homo sapiens
  Heavy chain CDR3 for antibody 12823 (IGHV3-20)
ARDRGSSGWRDWFDP

SEQ ID NO: 25647 - protein, 9 aa, Homo sapiens
  Light chain CDR3 for antibody 12824 (IGKV5-2)
LQHDNFPYT

SEQ ID NO: 25648 - protein, 14 aa, Homo sapiens
  Heavy chain CDR3 for antibody 12824 (IGHV3-33)
ARDGLVGASSWFDP

SEQ ID NO: 25649 - protein, 9 aa, Homo sapiens
  Light chain CDR3 for antibody 12825 (IGKV1-17)
LQHNSYPWT

SEQ ID NO: 25650 - protein, 12 aa, Homo sapiens
  Heavy chain CDR3 for antibody 12825 (IGHV1-24)
ATVLLWFGELDV

SEQ ID NO: 25651 - protein, 9 aa, Homo sapiens
  Light chain CDR3 for antibody 12826 (IGKV1D-13)
QQFNNYPHT

SEQ ID NO: 25652 - protein, 12 aa, Homo sapiens
  Heavy chain CDR3 for antibody 12826 (IGHV3-64)
ARVNSGSPYFDY

SEQ ID NO: 25653 - protein, 9 aa, Homo sapiens
  Light chain CDR3 for antibody 12827 (IGKV1-16)
QHYNDYPFT

SEQ ID NO: 25654 - protein, 13 aa, Homo sapiens
  Heavy chain CDR3 for antibody 12827 (IGHV4-39)
ARHEVMVRGVFDY

SEQ ID NO: 25655 - protein, 9 aa, Homo sapiens
  Light chain CDR3 for antibody 12828 (IGKV1-17)
LQLNSFPWT

SEQ ID NO: 25656 - protein, 14 aa, Homo sapiens
  Heavy chain CDR3 for antibody 12828 (IGHV3-33)
ARGAAAGNFYGLDV

SEQ ID NO: 25657 - protein, 11 aa, Homo sapiens
  Light chain CDR3 for antibody 12829 (IGKV3-11)
QQRSNWPPTWT

SEQ ID NO: 25658 - protein, 10 aa, Homo sapiens
  Heavy chain CDR3 for antibody 12829 (IGHV3-23)
AKGDRWRFDP

SEQ ID NO: 25659 - protein, 9 aa, Homo sapiens
  Light chain CDR3 for antibody 12830 (IGKV3-11)
QQRSNWPPT

SEQ ID NO: 25660 - protein, 21 aa, Homo sapiens
  Heavy chain CDR3 for antibody 12830 (IGHV3-33)
ARDEYYEIVTGYGYYHYGMDV

SEQ ID NO: 25661 - protein, 9 aa, Homo sapiens
  Light chain CDR3 for antibody 12831 (IGKV2D-24)
TQATQFPHT

SEQ ID NO: 25662 - protein, 15 aa, Homo sapiens
  Heavy chain CDR3 for antibody 12831 (IGHV3-33)
ARDSRPEIIGPPFDY

SEQ ID NO: 25663 - protein, 9 aa, Homo sapiens
  Light chain CDR3 for antibody 12832 (IGKV1-17)
LQHNSYPYT

SEQ ID NO: 25664 - protein, 19 aa, Homo sapiens
  Heavy chain CDR3 for antibody 12832 (IGHV3-74)
AGTYPTFYDGSGNYYDFDY

SEQ ID NO: 25665 - protein, 9 aa, Homo sapiens
  Light chain CDR3 for antibody 12833 (IGKV1-9)
QQVKSYPYT

SEQ ID NO: 25666 - protein, 6 aa, Homo sapiens
  Heavy chain CDR3 for antibody 12833 (IGHV1-46)
AREGTY

SEQ ID NO: 25667 - protein, 9 aa, Homo sapiens
  Light chain CDR3 for antibody 12834 (IGKV1-6)
LQDFHYPWT

SEQ ID NO: 25668 - protein, 18 aa, Homo sapiens
  Heavy chain CDR3 for antibody 12834 (IGHV3-23)
AKEGNYYGSGSYWGYFDP

SEQ ID NO: 25669 - protein, 9 aa, Homo sapiens
  Light chain CDR3 for antibody 12835 (IGKV2D-28)
MQALQTPPT

SEQ ID NO: 25670 - protein, 13 aa, Homo sapiens
  Heavy chain CDR3 for antibody 12835 (IGHV3-33)
AKEDGDYHHYFDY

SEQ ID NO: 25671 - protein, 10 aa, Homo sapiens
  Light chain CDR3 for antibody 12836 (IGKV3-20)
QQYGSSPPYT

SEQ ID NO: 25672 - protein, 16 aa, Homo sapiens
  Heavy chain CDR3 for antibody 12836 (IGHV1-8)
ARGHYYGSGSYYNFDY

SEQ ID NO: 25673 - protein, 9 aa, Homo sapiens
  Light chain CDR3 for antibody 12837 (IGKV3-11)
QQRINWPWT

SEQ ID NO: 25674 - protein, 8 aa, Homo sapiens
  Heavy chain CDR3 for antibody 12837 (IGHV4-59)
ARRGGLDY

SEQ ID NO: 25675 - protein, 9 aa, Homo sapiens
  Light chain CDR3 for antibody 12838 (IGKV2-30)
MQGTHWPLT

SEQ ID NO: 25676 - protein, 18 aa, Homo sapiens
  Heavy chain CDR3 for antibody 12838 (IGHV3-23)
AKPDYYGSGSYYNVPFDY

SEQ ID NO: 25677 - protein, 9 aa, Homo sapiens
  Light chain CDR3 for antibody 12839 (IGKV3-15)
QQYNDWPRT

SEQ ID NO: 25678 - protein, 17 aa, Homo sapiens
  Heavy chain CDR3 for antibody 12839 (IGHV3-33)
ARDLIGPLSSSWYPFDY

SEQ ID NO: 25679 - protein, 10 aa, Homo sapiens
  Light chain CDR3 for antibody 12840 (IGKV3-20)
QQYGRSPPVT

SEQ ID NO: 25680 - protein, 8 aa, Homo sapiens
  Heavy chain CDR3 for antibody 12840 (IGHV3-23)
EKSAGEDV

SEQ ID NO: 25681 - protein, 9 aa, Homo sapiens
  Light chain CDR3 for antibody 12841 (IGKV3-20)
QQYGISPYT

SEQ ID NO: 25682 - protein, 18 aa, Homo sapiens
  Heavy chain CDR3 for antibody 12841 (IGHV4-59)
AREGDYVWGSYRSNWFDP

SEQ ID NO: 25683 - protein, 9 aa, Homo sapiens
  Light chain CDR3 for antibody 12842 (IGKV1-9)
QQLHIYPWT

SEQ ID NO: 25684 - protein, 17 aa, Homo sapiens
  Heavy chain CDR3 for antibody 12842 (IGHV3-30)
AREGVRGLIYYYYGMDV

SEQ ID NO: 25685 - protein, 9 aa, Homo sapiens
  Light chain CDR3 for antibody 12843 (IGKV1-5)
QQYNTYSRT

SEQ ID NO: 25686 - protein, 13 aa, Homo sapiens
  Heavy chain CDR3 for antibody 12843 (IGHV3-33)
ARRYRSGWYPFDY

SEQ ID NO: 25687 - protein, 9 aa, Homo sapiens
  Light chain CDR3 for antibody 12844 (IGKV5-2)
LQHDKFPYT

SEQ ID NO: 25688 - protein, 14 aa, Homo sapiens
  Heavy chain CDR3 for antibody 12844 (IGHV3-33)
ARDLNYDILNGGGY

SEQ ID NO: 25689 - protein, 10 aa, Homo sapiens
  Light chain CDR3 for antibody 12845 (IGKV1-39)
QQSYSTPMYT

SEQ ID NO: 25690 - protein, 11 aa, Homo sapiens
  Heavy chain CDR3 for antibody 12845 (IGHV3-33)
ARDRATATLDY

SEQ ID NO: 25691 - protein, 9 aa, Homo sapiens
  Light chain CDR3 for antibody 12846 (IGKV1-16)
QQYNSYPYT

SEQ ID NO: 25692 - protein, 10 aa, Homo sapiens
  Heavy chain CDR3 for antibody 12846 (IGHV3-33)
ARGGLGTFDY

SEQ ID NO: 25693 - protein, 8 aa, Homo sapiens
  Light chain CDR3 for antibody 12847 (IGKV1-5)
QQYNSYYT

SEQ ID NO: 25694 - protein, 16 aa, Homo sapiens
  Heavy chain CDR3 for antibody 12847 (IGHV3-23)
AKEGEGLRYFDWLFNY

SEQ ID NO: 25695 - protein, 9 aa, Homo sapiens
  Light chain CDR3 for antibody 12848 (IGKV1-6)
LQDYNYPWT

SEQ ID NO: 25696 - protein, 17 aa, Homo sapiens
  Heavy chain CDR3 for antibody 12848 (IGHV3-33)
ARRTAAGTGDYYYGMDV

SEQ ID NO: 25697 - protein, 9 aa, Homo sapiens
  Light chain CDR3 for antibody 12849 (IGKV6-21)
HQSTSLPFT

SEQ ID NO: 25698 - protein, 18 aa, Homo sapiens
  Heavy chain CDR3 for antibody 12849 (IGHV4-39)
ARQYYFGSGNYYRGWFDH

SEQ ID NO: 25699 - protein, 9 aa, Homo sapiens
  Light chain CDR3 for antibody 12850 (IGKV1-16)
QHYNDYPFT

SEQ ID NO: 25700 - protein, 13 aa, Homo sapiens
  Heavy chain CDR3 for antibody 12850 (IGHV3-23)
AKDRGLRYYGMDV

SEQ ID NO: 25701 - protein, 8 aa, Homo sapiens
  Light chain CDR3 for antibody 12851 (IGKV3-11)
QQRSNWLT

SEQ ID NO: 25702 - protein, 14 aa, Homo sapiens
  Heavy chain CDR3 for antibody 12851 (IGHV1-8)
ARDQPTVPSGYFDY

SEQ ID NO: 25703 - protein, 9 aa, Homo sapiens
  Light chain CDR3 for antibody 12852 (IGKV1-39)
QQSYSTPIT

SEQ ID NO: 25704 - protein, 13 aa, Homo sapiens
  Heavy chain CDR3 for antibody 12852 (IGHV3-15)
TTDRLLLFGAFDY

SEQ ID NO: 25705 - protein, 9 aa, Homo sapiens
  Light chain CDR3 for antibody 12853 (IGKV1-39)
QQSYRTPLT

SEQ ID NO: 25706 - protein, 12 aa, Homo sapiens
  Heavy chain CDR3 for antibody 12853 (IGHV3-9)
AEDPFLGTSFDY

SEQ ID NO: 25707 - protein, 9 aa, Homo sapiens
  Light chain CDR3 for antibody 12854 (IGKV1-6)
LQGYNYPRS

SEQ ID NO: 25708 - protein, 16 aa, Homo sapiens
  Heavy chain CDR3 for antibody 12854 (IGHV3-23)
AKEGMVLRYFDWLWDY

SEQ ID NO: 25709 - protein, 9 aa, Homo sapiens
  Light chain CDR3 for antibody 12855 (IGKV1-17)
LHSNNYPWT

SEQ ID NO: 25710 - protein, 15 aa, Homo sapiens
  Heavy chain CDR3 for antibody 12855 (IGHV3-33)
VCVLYDYGDYVGFDY

SEQ ID NO: 25711 - protein, 10 aa, Homo sapiens
  Light chain CDR3 for antibody 12856 (IGKV3-15)
QQYNNWPPYT

SEQ ID NO: 25712 - protein, 13 aa, Homo sapiens
  Heavy chain CDR3 for antibody 12856 (IGHV1-46)
ARRQVGYYYGMDV

SEQ ID NO: 25713 - protein, 11 aa, Homo sapiens
  Light chain CDR3 for antibody 12857 (IGKV3-11)
QQRSNWPPTWT

SEQ ID NO: 25714 - protein, 17 aa, Homo sapiens
  Heavy chain CDR3 for antibody 12857 (IGHV3-15)
TTERYPRRYYYYFGMDV

SEQ ID NO: 25715 - protein, 9 aa, Homo sapiens
  Light chain CDR3 for antibody 12858 (IGKV3-20)
QQYGSSPYT

SEQ ID NO: 25716 - protein, 14 aa, Homo sapiens
  Heavy chain CDR3 for antibody 12858 (IGHV3-20)
ARGGSSGWYDWFDP

SEQ ID NO: 25717 - protein, 9 aa, Homo sapiens
  Light chain CDR3 for antibody 12859 (IGKV1-33)
QQYDNLPFT

SEQ ID NO: 25718 - protein, 14 aa, Homo sapiens
  Heavy chain CDR3 for antibody 12859 (IGHV3-64)
ARDHAAGGYSHSDY

SEQ ID NO: 25719 - protein, 9 aa, Homo sapiens
  Light chain CDR3 for antibody 12860 (IGKV1-16)
QKYNSAPHT

SEQ ID NO: 25720 - protein, 17 aa, Homo sapiens
  Heavy chain CDR3 for antibody 12860 (IGHV3-33)
VREGGLLWVGELSLFDY

SEQ ID NO: 25721 - protein, 8 aa, Homo sapiens
  Light chain CDR3 for antibody 12861 (IGKV6-21)
HQSSSLPT

SEQ ID NO: 25722 - protein, 15 aa, Homo sapiens
  Heavy chain CDR3 for antibody 12861 (IGHV3-33)
ARDTGYSSSWNWFDP

SEQ ID NO: 25723 - protein, 9 aa, Homo sapiens
  Light chain CDR3 for antibody 12862 (IGKV6-21)
HQSTSLPFT

SEQ ID NO: 25724 - protein, 13 aa, Homo sapiens
  Heavy chain CDR3 for antibody 12862 (IGHV4-39)
ARRDGSYYGYFGY

SEQ ID NO: 25725 - protein, 9 aa, Homo sapiens
  Light chain CDR3 for antibody 12863 (IGKV1-33)
QQYDNLPFT

SEQ ID NO: 25726 - protein, 13 aa, Homo sapiens
  Heavy chain CDR3 for antibody 12863 (IGHV3-53)
ARSGSYWGYYFDY

SEQ ID NO: 25727 - protein, 9 aa, Homo sapiens
  Light chain CDR3 for antibody 12864 (IGKV3-11)
QQRINWPPT

SEQ ID NO: 25728 - protein, 18 aa, Homo sapiens
  Heavy chain CDR3 for antibody 12864 (IGHV3-33)
ARGGVLYDILTGFYGMDV

SEQ ID NO: 25729 - protein, 9 aa, Homo sapiens
  Light chain CDR3 for antibody 12865 (IGKV1-17)
LQHNSYPYT

SEQ ID NO: 25730 - protein, 18 aa, Homo sapiens
  Heavy chain CDR3 for antibody 12865 (IGHV3-23)
AKDRRTGTTYGYYYGLDV

SEQ ID NO: 25731 - protein, 9 aa, Homo sapiens
  Light chain CDR3 for antibody 12866 (IGKV2D-24)
TQATQFPHT

SEQ ID NO: 25732 - protein, 13 aa, Homo sapiens
  Heavy chain CDR3 for antibody 12866 (IGHV1-18)
ARDEGYSGYVLDN

SEQ ID NO: 25733 - protein, 9 aa, Homo sapiens
  Light chain CDR3 for antibody 12867 (IGKV3-20)
QQYGSSPRT

SEQ ID NO: 25734 - protein, 23 aa, Homo sapiens
  Heavy chain CDR3 for antibody 12867 (IGHV3-30)
ARDGDYFGSGSQRDYHYYYGLDV

SEQ ID NO: 25735 - protein, 9 aa, Homo sapiens
  Light chain CDR3 for antibody 12868 (IGKV1D-16)
QLYGSSPYT

SEQ ID NO: 25736 - protein, 9 aa, Homo sapiens
  Heavy chain CDR3 for antibody 12868 (IGHV4-59)
ARSGSWIYT

SEQ ID NO: 25737 - protein, 11 aa, Homo sapiens
  Light chain CDR3 for antibody 12869 (IGKV3-11)
QQRSNWPPMYT

SEQ ID NO: 25738 - protein, 11 aa, Homo sapiens
  Heavy chain CDR3 for antibody 12869 (IGHV4-59)
ARDRGHYGMDV

SEQ ID NO: 25739 - protein, 9 aa, Homo sapiens
  Light chain CDR3 for antibody 12870 (IGKV1D-16)
QQYITYPYT

SEQ ID NO: 25740 - protein, 18 aa, Homo sapiens
  Heavy chain CDR3 for antibody 12870 (IGHV3-33)
VRDRERYGSGSYPDAFDI

SEQ ID NO: 25741 - protein, 8 aa, Homo sapiens
  Light chain CDR3 for antibody 12871 (IGKV3-11)
LQRGNWPT

SEQ ID NO: 25742 - protein, 14 aa, Homo sapiens
  Heavy chain CDR3 for antibody 12871 (IGHV3-33)
ARAGSGYDRDWFDP

SEQ ID NO: 25743 - protein, 9 aa, Homo sapiens
  Light chain CDR3 for antibody 12872 (IGKV1-17)
LQHTSYPFT

SEQ ID NO: 25744 - protein, 10 aa, Homo sapiens
  Heavy chain CDR3 for antibody 12872 (IGHV1-2)
AKDHYGDYPY

SEQ ID NO: 25745 - protein, 9 aa, Homo sapiens
  Light chain CDR3 for antibody 12873 (IGKV3-15)
QQYNNWPLT

SEQ ID NO: 25746 - protein, 13 aa, Homo sapiens
  Heavy chain CDR3 for antibody 12873 (IGHV4-39)
ARRDGGYYGYCDY

SEQ ID NO: 25747 - protein, 9 aa, Homo sapiens
  Light chain CDR3 for antibody 12874 (IGKV3D-20)
HQYGSSPLT

SEQ ID NO: 25748 - protein, 13 aa, Homo sapiens
  Heavy chain CDR3 for antibody 12874 (IGHV4-39)
ARQGVLAPAAFDH

SEQ ID NO: 25749 - protein, 8 aa, Homo sapiens
  Light chain CDR3 for antibody 12875 (IGKV3-11)
LQRGNWPT

SEQ ID NO: 25750 - protein, 17 aa, Homo sapiens
  Heavy chain CDR3 for antibody 12875 (IGHV3-33)
ARVRGVIEGYYYYGMDV

SEQ ID NO: 25751 - protein, 10 aa, Homo sapiens
  Light chain CDR3 for antibody 12876 (IGKV1-17)
LQHNSYPMYT

SEQ ID NO: 25752 - protein, 8 aa, Homo sapiens
  Heavy chain CDR3 for antibody 12876 (IGHV3-20)
APHWIFDY

SEQ ID NO: 25753 - protein, 9 aa, Homo sapiens
  Light chain CDR3 for antibody 12877 (IGKV3-15)
QQYNDWPLT

SEQ ID NO: 25754 - protein, 14 aa, Homo sapiens
  Heavy chain CDR3 for antibody 12877 (IGHV3-33)
AKSYDILTGEAFDI

SEQ ID NO: 25755 - protein, 9 aa, Homo sapiens
  Light chain CDR3 for antibody 12878 (IGKV6-21)
QQSSNLPHT

SEQ ID NO: 25756 - protein, 13 aa, Homo sapiens
  Heavy chain CDR3 for antibody 12878 (IGHV3-33)
ARDYCGGDCYLDY

SEQ ID NO: 25757 - protein, 9 aa, Homo sapiens
  Light chain CDR3 for antibody 12879 (IGKV3D-7)
QQDSNLPYT

SEQ ID NO: 25758 - protein, 13 aa, Homo sapiens
  Heavy chain CDR3 for antibody 12879 (IGHV4-59)
ANRDYYGYYGMDV

SEQ ID NO: 25759 - protein, 9 aa, Homo sapiens
  Light chain CDR3 for antibody 12880 (IGKV6-21)
QQSSNLPHT

SEQ ID NO: 25760 - protein, 16 aa, Homo sapiens
  Heavy chain CDR3 for antibody 12880 (IGHV3-33)
ARAVYYGSGSSLIMDV

SEQ ID NO: 25761 - protein, 8 aa, Homo sapiens
  Light chain CDR3 for antibody 12881 (IGKV1-6)
QQFNTYPT

SEQ ID NO: 25762 - protein, 12 aa, Homo sapiens
  Heavy chain CDR3 for antibody 12881 (IGHV4-39)
ARHGSGSSYFDY

SEQ ID NO: 25763 - protein, 9 aa, Homo sapiens
  Light chain CDR3 for antibody 12882 (IGKV3D-7)
QQDYTLPLT

SEQ ID NO: 25764 - protein, 13 aa, Homo sapiens
  Heavy chain CDR3 for antibody 12882 (IGHV3-33)
ARTDYYYYYGMDV

SEQ ID NO: 25765 - protein, 8 aa, Homo sapiens
  Light chain CDR3 for antibody 12883 (IGKV3-20)
QQYGSSLT

SEQ ID NO: 25766 - protein, 18 aa, Homo sapiens
  Heavy chain CDR3 for antibody 12883 (IGHV3-33)
ARGGYSSGWDYYYYGMDV

SEQ ID NO: 25767 - protein, 9 aa, Homo sapiens
  Light chain CDR3 for antibody 12884 (IGKV3-11)
QHRGNWPLT

SEQ ID NO: 25768 - protein, 12 aa, Homo sapiens
  Heavy chain CDR3 for antibody 12884 (IGHV3-13)
AREAGIPDAFDI

SEQ ID NO: 25769 - protein, 10 aa, Homo sapiens
  Light chain CDR3 for antibody 12885 (IGKV3-11)
QQRSNWPALA

SEQ ID NO: 25770 - protein, 14 aa, Homo sapiens
  Heavy chain CDR3 for antibody 12885 (IGHV3-20)
ARDGGSTCYDWFDP

SEQ ID NO: 25771 - protein, 9 aa, Homo sapiens
  Light chain CDR3 for antibody 12886 (IGKV1-9)
QQLISYPLT

SEQ ID NO: 25772 - protein, 15 aa, Homo sapiens
  Heavy chain CDR3 for antibody 12886 (IGHV3-33)
ARKRLYDILTGHYDY

SEQ ID NO: 25773 - protein, 9 aa, Homo sapiens
  Light chain CDR3 for antibody 12887 (IGKV3-15)
QQYINWPRT

SEQ ID NO: 25774 - protein, 13 aa, Homo sapiens
  Heavy chain CDR3 for antibody 12887 (IGHV3-33)
ASGYSGYDWYFDL

SEQ ID NO: 25775 - protein, 9 aa, Homo sapiens
  Light chain CDR3 for antibody 12888 (IGKV2D-24)
MQATQFPHT

SEQ ID NO: 25776 - protein, 8 aa, Homo sapiens
  Heavy chain CDR3 for antibody 12888 (IGHV3-23)
AETFLFDY

SEQ ID NO: 25777 - protein, 11 aa, Homo sapiens
  Light chain CDR3 for antibody 12889 (IGKV3-11)
QQRSNWPPTWT

SEQ ID NO: 25778 - protein, 19 aa, Homo sapiens
  Heavy chain CDR3 for antibody 12889 (IGHV5-51)
ARHGEKGKRITMVRGSLDA

SEQ ID NO: 25779 - protein, 10 aa, Homo sapiens
  Light chain CDR3 for antibody 12890 (IGKV3-15)
QQYNNWPPYT

SEQ ID NO: 25780 - protein, 17 aa, Homo sapiens
  Heavy chain CDR3 for antibody 12890 (IGHV4-59)
ARDFLVRGEGSYYGMDV

SEQ ID NO: 25781 - protein, 9 aa, Homo sapiens
  Light chain CDR3 for antibody 12891 (IGKV3-15)
QQYNNWPYT

SEQ ID NO: 25782 - protein, 16 aa, Homo sapiens
  Heavy chain CDR3 for antibody 12891 (IGHV3-33)
ARGGRSDWLYYYGIDV

SEQ ID NO: 25783 - protein, 10 aa, Homo sapiens
  Light chain CDR3 for antibody 12892 (IGKV3-15)
QQYNNWPPYT

SEQ ID NO: 25784 - protein, 14 aa, Homo sapiens
  Heavy chain CDR3 for antibody 12892 (IGHV1-24)
ATWLPLYYYYGMDV

SEQ ID NO: 25785 - protein, 9 aa, Homo sapiens
  Light chain CDR3 for antibody 12893 (IGKV1D-13)
QRFNNYLYT

SEQ ID NO: 25786 - protein, 12 aa, Homo sapiens
  Heavy chain CDR3 for antibody 12893 (IGHV3-13)
ARDRGYSGYFDY

SEQ ID NO: 25787 - protein, 10 aa, Homo sapiens
  Light chain CDR3 for antibody 12894 (IGKV3-11)
QQRSNWPIFT

SEQ ID NO: 25788 - protein, 16 aa, Homo sapiens
  Heavy chain CDR3 for antibody 12894 (IGHV3-33)
ARDKNTDYDILTGFDY

SEQ ID NO: 25789 - protein, 9 aa, Homo sapiens
  Light chain CDR3 for antibody 12895 (IGKV1-16)
QQYNSFPYT

SEQ ID NO: 25790 - protein, 22 aa, Homo sapiens
  Heavy chain CDR3 for antibody 12895 (IGHV3-11)
ARDVRDYDILTGYYNGGNYFDY

SEQ ID NO: 25791 - protein, 8 aa, Homo sapiens
  Light chain CDR3 for antibody 12896 (IGKV3-11)
LQRGNWPT

SEQ ID NO: 25792 - protein, 13 aa, Homo sapiens
  Heavy chain CDR3 for antibody 12896 (IGHV3-33)
ARDPLYSGSYFDY

SEQ ID NO: 25793 - protein, 9 aa, Homo sapiens
  Light chain CDR3 for antibody 12897 (IGKV1-27)
QKYNSAPYT

SEQ ID NO: 25794 - protein, 14 aa, Homo sapiens
  Heavy chain CDR3 for antibody 12897 (IGHV3-33)
AKDRYRGYEGLFDY

SEQ ID NO: 25795 - protein, 10 aa, Homo sapiens
  Light chain CDR3 for antibody 12898 (IGKV3-11)
QQRSTWPTLI

SEQ ID NO: 25796 - protein, 12 aa, Homo sapiens
  Heavy chain CDR3 for antibody 12898 (IGHV3-23)
ARGLTGDHALDI

SEQ ID NO: 25797 - protein, 8 aa, Homo sapiens
  Light chain CDR3 for antibody 12899 (IGKV3D-7)
QQDYNLLT

SEQ ID NO: 25798 - protein, 16 aa, Homo sapiens
  Heavy chain CDR3 for antibody 12899 (IGHV3-13)
ARDRSYESYYYYGMDV

SEQ ID NO: 25799 - protein, 8 aa, Homo sapiens
  Light chain CDR3 for antibody 12900 (IGKV6-21)
HQSSSLPT

SEQ ID NO: 25800 - protein, 15 aa, Homo sapiens
  Heavy chain CDR3 for antibody 12900 (IGHV3-33)
ARRGYNDYDPYGMDV

SEQ ID NO: 25801 - protein, 9 aa, Homo sapiens
  Light chain CDR3 for antibody 12901 (IGKV1-6)
LQDYNYPYT

SEQ ID NO: 25802 - protein, 13 aa, Homo sapiens
  Heavy chain CDR3 for antibody 12901 (IGHV4-61)
ARMGREQWLGFDY

SEQ ID NO: 25803 - protein, 8 aa, Homo sapiens
  Light chain CDR3 for antibody 12902 (IGKV3D-7)
QQDYNLLT

SEQ ID NO: 25804 - protein, 9 aa, Homo sapiens
  Heavy chain CDR3 for antibody 12902 (IGHV1-18)
ARGGWGFEY

SEQ ID NO: 25805 - protein, 10 aa, Homo sapiens
  Light chain CDR3 for antibody 12903 (IGKV1-17)
LQHNSYPMYT

SEQ ID NO: 25806 - protein, 14 aa, Homo sapiens
  Heavy chain CDR3 for antibody 12903 (IGHV3-33)
VRDAMGATTAWFDP

SEQ ID NO: 25807 - protein, 10 aa, Homo sapiens
  Light chain CDR3 for antibody 12904 (IGKV1-9)
QQLNSFLMYT

SEQ ID NO: 25808 - protein, 11 aa, Homo sapiens
  Heavy chain CDR3 for antibody 12904 (IGHV3-33)
ARDRSSGPFDY

SEQ ID NO: 25809 - protein, 10 aa, Homo sapiens
  Light chain CDR3 for antibody 12905 (IGKV1-6)
LQDYNYPMYT

SEQ ID NO: 25810 - protein, 11 aa, Homo sapiens
  Heavy chain CDR3 for antibody 12905 (IGHV3-23)
AKGLWSYYFDY

SEQ ID NO: 25811 - protein, 9 aa, Homo sapiens
  Light chain CDR3 for antibody 12906 (IGKV3-15)
QQYNNWPYT

SEQ ID NO: 25812 - protein, 16 aa, Homo sapiens
  Heavy chain CDR3 for antibody 12906 (IGHV3-30)
ARDIAVAGHVYYGMDV

SEQ ID NO: 25813 - protein, 9 aa, Homo sapiens
  Light chain CDR3 for antibody 12907 (IGKV3D-7)
QQDYEFPIT

SEQ ID NO: 25814 - protein, 10 aa, Homo sapiens
  Heavy chain CDR3 for antibody 12907 (IGHV3-23)
AKGDRWRFDP

SEQ ID NO: 25815 - protein, 9 aa, Homo sapiens
  Light chain CDR3 for antibody 12908 (IGKV2-30)
MQGTHWPLT

SEQ ID NO: 25816 - protein, 18 aa, Homo sapiens
  Heavy chain CDR3 for antibody 12908 (IGHV3-23)
AKVGDFFASGNYWDYFDY

SEQ ID NO: 25817 - protein, 8 aa, Homo sapiens
  Light chain CDR3 for antibody 12909 (IGKV3-11)
LQRGNWPT

SEQ ID NO: 25818 - protein, 11 aa, Homo sapiens
  Heavy chain CDR3 for antibody 12909 (IGHV3-15)
ARDRGNWGFDY

SEQ ID NO: 25819 - protein, 9 aa, Homo sapiens
  Light chain CDR3 for antibody 12910 (IGKV3-20)
QQYGSSPYT

SEQ ID NO: 25820 - protein, 15 aa, Homo sapiens
  Heavy chain CDR3 for antibody 12910 (IGHV3-33)
ARRGGIAAAGYYFDY

SEQ ID NO: 25821 - protein, 9 aa, Homo sapiens
  Light chain CDR3 for antibody 12911 (IGKV1-9)
QQLKSYLYT

SEQ ID NO: 25822 - protein, 16 aa, Homo sapiens
  Heavy chain CDR3 for antibody 12911 (IGHV3-33)
ARDNFGSGSYYSHFHY

SEQ ID NO: 25823 - protein, 9 aa, Homo sapiens
  Light chain CDR3 for antibody 12912 (IGKV3-11)
QQRINWPWT

SEQ ID NO: 25824 - protein, 19 aa, Homo sapiens
  Heavy chain CDR3 for antibody 12912 (IGHV5-51)
ARHGEKGKRITMVRGSLDV

SEQ ID NO: 25825 - protein, 8 aa, Homo sapiens
  Light chain CDR3 for antibody 12913 (IGKV1D-13)
QQFNNYPT

SEQ ID NO: 25826 - protein, 19 aa, Homo sapiens
  Heavy chain CDR3 for antibody 12913 (IGHV3-33)
AREDYYGSGSYYNEDWFDP

SEQ ID NO: 25827 - protein, 8 aa, Homo sapiens
  Light chain CDR3 for antibody 12914 (IGKV3D-7)
QQDYNLLT

SEQ ID NO: 25828 - protein, 14 aa, Homo sapiens
  Heavy chain CDR3 for antibody 12914 (IGHV3-33)
ARTTAAAGPRDFQH

SEQ ID NO: 25829 - protein, 9 aa, Homo sapiens
  Light chain CDR3 for antibody 12915 (IGKV1-6)
LQDYNHPWT

SEQ ID NO: 25830 - protein, 9 aa, Homo sapiens
  Heavy chain CDR3 for antibody 12915 (IGHV3-30)
VRDNWGFDY

SEQ ID NO: 25831 - protein, 8 aa, Homo sapiens
  Light chain CDR3 for antibody 12916 (IGKV6-21)
HQSSSLPT

SEQ ID NO: 25832 - protein, 10 aa, Homo sapiens
  Heavy chain CDR3 for antibody 12916 (IGHV4-34)
ARDLGWSFDH

SEQ ID NO: 25833 - protein, 10 aa, Homo sapiens
  Light chain CDR3 for antibody 12917 (IGKV1-9)
QQLDSYPMYT

SEQ ID NO: 25834 - protein, 11 aa, Homo sapiens
  Heavy chain CDR3 for antibody 12917 (IGHV3-33)
ARDTWDDYFDY

SEQ ID NO: 25835 - protein, 8 aa, Homo sapiens
  Light chain CDR3 for antibody 12918 (IGKV2D-28)
MQALQTPT

SEQ ID NO: 25836 - protein, 13 aa, Homo sapiens
  Heavy chain CDR3 for antibody 12918 (IGHV3-33)
ARDWGYSHGYFDY

SEQ ID NO: 25837 - protein, 10 aa, Homo sapiens
  Light chain CDR3 for antibody 12919 (IGKV3-11)
QQRSNWPIFT

SEQ ID NO: 25838 - protein, 12 aa, Homo sapiens
  Heavy chain CDR3 for antibody 12919 (IGHV1-18)
AGVLFDGDYSDY

SEQ ID NO: 25839 - protein, 8 aa, Homo sapiens
  misc_feature (5)..(8): Xaa can be any naturally occurring amino acid
GFTFXXXX

SEQ ID NO: 25840 - protein, 8 aa, Homo sapiens
  misc_feature (5)..(5): Xaa can be Ser or Asp
  misc_feature (6)..(6): Xaa can be Ser or Asp
  misc_feature (7)..(7): Xaa can be Tyr or His or Asp
  misc_feature (8)..(8): Xaa can be Ala or Gly or Tyr or Phe
GFTFXXXX

SEQ ID NO: 25841 - protein, 8 aa, Homo sapiens
GFTFSSYA

SEQ ID NO: 25842 - protein, 8 aa, Homo sapiens
GFTFSSYG

SEQ ID NO: 25843 - protein, 8 aa, Homo sapiens
  misc_feature (7)..(7): Xaa can be Tyr or His
GFTFDDXG

SEQ ID NO: 25844 - protein, 8 aa, Homo sapiens
  misc_feature (7)..(7): Xaa can be Tyr or Asp
  misc_feature (8)..(8): Xaa can be Tyr or Phe
GFTFSDXX

SEQ ID NO: 25845 - protein, 8 aa, Homo sapiens
  misc_feature (2)..(4): Xaa can be any naturally occurring amino acid
  misc_feature (6)..(8): Xaa can be any naturally occurring amino acid
IXXXGXXX

SEQ ID NO: 25846 - protein, 8 aa, Homo sapiens
  misc_feature (2)..(2): Xaa can be Trp or Ser or Asn
  misc_feature (3)..(3): Xaa can be Gly or Tyr or Trp
  misc_feature (4)..(4): Xaa can be Ser or Asp or Asn
  misc_feature (6)..(6): Xaa can be Gly or Ser or Asp or Tyr
  misc_feature (7)..(7): Xaa can be Ser or Asn or Thr
  misc_feature (8)..(8): Xaa can be Thr or Lys or Ile
IXXXGXXX

SEQ ID NO: 25847 - protein, 8 aa, Homo sapiens
ISGSGGST

SEQ ID NO: 25848 - protein, 8 aa, Homo sapiens
  misc_feature (2)..(2): Xaa can be Trp or Ser
IXYDGSNK

SEQ ID NO: 25849 - protein, 8 aa, Homo sapiens
  misc_feature (6)..(6): Xaa can be Gly or Asp
INWNGXST

SEQ ID NO: 25850 - protein, 8 aa, Homo sapiens
  misc_feature (6)..(6): Xaa can be Ser or Tyr
ISGSGXTI

SEQ ID NO: 25851 - protein, 16 aa, Homo sapiens
AKEGMVLRYFDWLWDY

SEQ ID NO: 25852 - protein, 12 aa, Homo sapiens
  misc_feature (2)..(4): Xaa can be any naturally occurring amino acid
  misc_feature (7)..(7): Xaa can be any naturally occurring amino acid
  misc_feature (9)..(9): Xaa can be any naturally occurring amino acid
RXXXSGXSXFDY

SEQ ID NO: 25853 - protein, 12 aa, Homo sapiens
  misc_feature (2)..(7): Xaa can be any naturally occurring amino acid
  misc_feature (9)..(11): Xaa can be any naturally occurring amino acid
AXXXXXXVXXXY

SEQ ID NO: 25854 - protein, 15 aa, Homo sapiens
  misc_feature (3)..(4): Xaa can be any naturally occurring amino acid
  misc_feature (7)..(10): Xaa can be any naturally occurring amino acid
  misc_feature (12)..(12): Xaa can be any naturally occurring amino acid
  misc_feature (15)..(15): Xaa can be any naturally occurring amino acid
ARXXGSXXXXDXFDX

SEQ ID NO: 25855 - protein, 13 aa, Homo sapiens
  misc_feature (7)..(7): Xaa can be any naturally occurring amino acid
  misc_feature (10)..(10): Xaa can be any naturally occurring amino acid
  misc_feature (13)..(13): Xaa can be any naturally occurring amino acid
ARDEGYXGYXLDX

SEQ ID NO: 25856 - protein, 16 aa, Homo sapiens
AKEGMVLRYFDWLWDY

SEQ ID NO: 25857 - protein, 12 aa, Homo sapiens
  misc_feature (2)..(2): Xaa can be Asp or Glu
  misc_feature (3)..(3): Xaa can be Arg or Leu
  misc_feature (4)..(4): Xaa can be Ser or Val or Leu
  misc_feature (7)..(7): Xaa can be Pro or Trp
  misc_feature (9)..(9): Xaa can be Gly or His
RXXXSGXSXFDY

SEQ ID NO: 25858 - protein, 12 aa, Homo sapiens
  misc_feature (2)..(2): Xaa can be Lys or Glu or Arg
  misc_feature (3)..(3): Xaa can be Glu or Thr
  misc_feature (4)..(4): Xaa can be Gln or Leu or Thr
  misc_feature (5)..(5): Xaa can be Leu or Trp or Ile
  misc_feature (6)..(6): Xaa can be Leu or Val or Trp or Asn
  misc_feature (7)..(7): Xaa can be Gly or Leu
  misc_feature (9)..(9): Xaa can be Val or Pro or Leu
  misc_feature (10)..(10): Xaa can be Phe or Leu or Asn
  misc_feature (11)..(11): Xaa can be Asp or Asn
AXXXXXXVXXXY

SEQ ID NO: 25859 - protein, 15 aa, Homo sapiens
  misc_feature (3)..(3): Xaa can be Asp or Asn
  misc_feature (4)..(4): Xaa can be Arg or Gly
  misc_feature (7)..(7): Xaa can be Ser or Thr
  misc_feature (8)..(8): Xaa can be Gly or Ser or Trp or Phe
  misc_feature (9)..(9): Xaa can be Trp or Phe or Tyr
  misc_feature (10)..(10): Xaa can be Arg or Phe or Tyr
  misc_feature (12)..(12): Xaa can be Trp or Ala
  misc_feature (15)..(15): Xaa can be Pro or Ile
ARXXGSXXXXDXFDX

SEQ ID NO: 25860 - protein, 13 aa, Homo sapiens
  misc_feature (7)..(7): Xaa can be Arg or Ser
  misc_feature (10)..(10): Xaa can be Val or Asn
  misc_feature (13)..(13): Xaa can be Thr or Asn or Ser
ARDEGYXGYXLDX

SEQ ID NO: 25861 - DNA, 27 bp, Artificial Sequence
  Description of Artificial Sequence: Synthetic oligonucleotide
ggactggacatccagwtgacccagtct

SEQ ID NO: 25862 - DNA, 27 bp, Artificial Sequence
  Description of Artificial Sequence: Synthetic oligonucleotide
ggactggatgttgtgatgactcagtct

SEQ ID NO: 25863 - DNA, 27 bp, Artificial Sequence
  Description of Artificial Sequence: Synthetic oligonucleotide
ggactggaaattgtgwtgacrcagtct

SEQ ID NO: 25864 - DNA, 25 bp, Artificial Sequence
  Description of Artificial Sequence: Synthetic oligonucleotide
ggactggaaacgacactcacgcagt

SEQ ID NO: 25865 - DNA, 27 bp, Artificial Sequence
  Description of Artificial Sequence: Synthetic oligonucleotide
ggactggaaattgtgctgactcagtct

SEQ ID NO: 25866 - DNA, 51 bp, Artificial Sequence
  Description of Artificial Sequence: Synthetic oligonucleotide
gccgccgctggaacttgacctagagctagcgacagatggtgcagccacagt

SEQ ID NO: 25867 - DNA, 64 bp, Artificial Sequence
  Description of Artificial Sequence: Synthetic oligonucleotide
aggtcaagttccagcggcggcggtggcagcggaggcggcgctagccagrtgcagctggtgcart

SEQ ID NO: 25868 - DNA, 64 bp, Artificial Sequence
  Description of Artificial Sequence: Synthetic oligonucleotide
aggtcaagttccagcggcggcggtggcagcggaggcggcgctagcsaggtccagctggtrcagt

SEQ ID NO: 25869 - DNA, 64 bp, Artificial Sequence
  Description of Artificial Sequence: Synthetic oligonucleotide
aggtcaagttccagcggcggcggtggcagcggaggcggcgctagccagrtcaccttgaaggagt

SEQ ID NO: 25870 - DNA, 63 bp, Artificial Sequence
  Description of Artificial Sequence: Synthetic oligonucleotide
aggtcaagttccagcggcggcggtggcagcggaggcggcgctagcsaggtgcagctggtggag

SEQ ID NO: 25871 - DNA, 64 bp, Artificial Sequence
  Description of Artificial Sequence: Synthetic oligonucleotide
aggtcaagttccagcggcggcggtggcagcggaggcggcgctagccaggtgcagctacagcagt

SEQ ID NO: 25872 - DNA, 64 bp, Artificial Sequence
  Description of Artificial Sequence: Synthetic oligonucleotide
aggtcaagttccagcggcggcggtggcagcggaggcggcgctagccagstgcagctgcaggagt

SEQ ID NO: 25873 - DNA, 64 bp, Artificial Sequence
  Description of Artificial Sequence: Synthetic oligonucleotide
aggtcaagttccagcggcggcggtggcagcggaggcggcgctagcgargtgcagctggtgcagt

SEQ ID NO: 25874 - DNA, 65 bp, Artificial Sequence
  Description of Artificial Sequence: Synthetic oligonucleotide
aggtcaagttccagcggcggcggtggcagcggaggcggcgctagccaggtacagctgcagcagtc

SEQ ID NO: 25875 - DNA, 20 bp, Artificial Sequence
  Description of Artificial Sequence: Synthetic oligonucleotide
ccryggctttgtcttggcat

SEQ ID NO: 25876 - DNA, 27 bp, Artificial Sequence
  Description of Artificial Sequence: Synthetic oligonucleotide
ggactggacatccagwtgacccagtct

SEQ ID NO: 25877 - DNA, 27 bp, Artificial Sequence
  Description of Artificial Sequence: Synthetic oligonucleotide
ggactggatgttgtgatgactcagtct

SEQ ID NO: 25878 - DNA, 27 bp, Artificial Sequence
  Description of Artificial Sequence: Synthetic oligonucleotide
ggactggaaattgtgwtgacrcagtct

SEQ ID NO: 25879 - DNA, 25 bp, Artificial Sequence
  Description of Artificial Sequence: Synthetic oligonucleotide
ggactggaaacgacactcacgcagt

SEQ ID NO: 25880 - DNA, 27 bp, Artificial Sequence
  Description of Artificial Sequence: Synthetic oligonucleotide
ggactggaaattgtgctgactcagtct

SEQ ID NO: 25881 - DNA, 54 bp, Artificial Sequence
  Description of Artificial Sequence: Synthetic oligonucleotide
gccgccgctggaacttgacctagagctagctggtgcagcaacagtccgtttgat

SEQ ID NO: 25882 - DNA, 64 bp, Artificial Sequence; identical to SEQ ID NO: 25867
  Description of Artificial Sequence: Synthetic oligonucleotide

SEQ ID NO: 25883 - DNA, 64 bp, Artificial Sequence; identical to SEQ ID NO: 25868
  Description of Artificial Sequence: Synthetic oligonucleotide

SEQ ID NO: 25884 - DNA, 64 bp, Artificial Sequence; identical to SEQ ID NO: 25869
  Description of Artificial Sequence: Synthetic oligonucleotide

SEQ ID NO: 25885 - DNA, 63 bp, Artificial Sequence; identical to SEQ ID NO: 25870
  Description of Artificial Sequence: Synthetic oligonucleotide

SEQ ID NO: 25886 - DNA, 64 bp, Artificial Sequence; identical to SEQ ID NO: 25871
  Description of Artificial Sequence: Synthetic oligonucleotide

SEQ ID NO: 25887 - DNA, 64 bp, Artificial Sequence; identical to SEQ ID NO: 25872
  Description of Artificial Sequence: Synthetic oligonucleotide

SEQ ID NO: 25888 - DNA, 64 bp, Artificial Sequence; identical to SEQ ID NO: 25873
  Description of Artificial Sequence: Synthetic oligonucleotide

SEQ ID NO: 25889 - DNA, 65 bp, Artificial Sequence; identical to SEQ ID NO: 25874
  Description of Artificial Sequence: Synthetic oligonucleotide

SEQ ID NO: 25890 - DNA, 23 bp, Artificial Sequence
  Description of Artificial Sequence: Synthetic oligonucleotide
acaaaccagctgahmtggacvtc

SEQ ID NO: 25891 - DNA, 51 bp, Artificial Sequence
  Description of Artificial Sequence: Synthetic oligonucleotide
ggaggttctggtggtggtggatctgctagcgacatccagwtgacccagtct

SEQ ID NO: 25892 - DNA, 51 bp, Artificial Sequence
  Description of Artificial Sequence: Synthetic oligonucleotide
ggaggttctggtggtggtggatctgctagcgatgttgtgatgactcagtct

SEQ ID NO: 25893 - DNA, 51 bp, Artificial Sequence
  Description of Artificial Sequence: Synthetic oligonucleotide
ggaggttctggtggtggtggatctgctagcgaaattgtgwtgacrcagtct

SEQ ID NO: 25894 - DNA, 49 bp, Artificial Sequence
  Description of Artificial Sequence: Synthetic oligonucleotide
ggaggttctggtggtggtggatctgctagcgaaacgacactcacgcagt

SEQ ID NO: 25895 - DNA, 51 bp, Artificial Sequence
  Description of Artificial Sequence: Synthetic oligonucleotide
ggaggttctggtggtggtggatctgctagcgaaattgtgctgactcagtct

SEQ ID NO: 25896 - DNA, 48 bp, Artificial Sequence
  Description of Artificial Sequence: Synthetic oligonucleotide
ttcttcagaaataagcttttgttcggatccgaagaccgatgggccctt

SEQ ID NO: 25897 - DNA, 51 bp, Artificial Sequence
  Description of Artificial Sequence: Synthetic oligonucleotide
ttcctgtcagtaacgactggtgtccactccgacatccagwtgacccagtct

SEQ ID NO: 25898 - DNA, 51 bp, Artificial Sequence
  Description of Artificial Sequence: Synthetic oligonucleotide
ttcctgtcagtaacgactggtgtccactccgatgttgtgatgactcagtct

SEQ ID NO: 25899 - DNA, 51 bp, Artificial Sequence
  Description of Artificial Sequence: Synthetic oligonucleotide
ttcctgtcagtaacgactggtgtccactccgaaattgtgwtgacrcagtct

SEQ ID NO: 25900 - DNA, 49 bp, Artificial Sequence
  Description of Artificial Sequence: Synthetic oligonucleotide
ttcctgtcagtaacgactggtgtccactccgaaacgacactcacgcagt

SEQ ID NO: 25901 - DNA, 51 bp, Artificial Sequence
  Description of Artificial Sequence: Synthetic oligonucleotide
ttcctgtcagtaacgactggtgtccactccgaaattgtgctgactcagtct

SEQ ID NO: 25902 - DNA, 18 bp, Artificial Sequence
  Description of Artificial Sequence: Synthetic oligonucleotide
gaagaccgatgggccctt

SEQ ID NO: 25903 - DNA, 51 bp, Artificial Sequence; identical to SEQ ID NO: 25897
  Description of Artificial Sequence: Synthetic oligonucleotide

SEQ ID NO: 25904 - DNA, 51 bp, Artificial Sequence; identical to SEQ ID NO: 25898
  Description of Artificial Sequence: Synthetic oligonucleotide

SEQ ID NO: 25905 - DNA, 51 bp, Artificial Sequence; identical to SEQ ID NO: 25899
  Description of Artificial Sequence: Synthetic oligonucleotide

SEQ ID NO: 25906 - DNA, 49 bp, Artificial Sequence; identical to SEQ ID NO: 25900
  Description of Artificial Sequence: Synthetic oligonucleotide

SEQ ID NO: 25907 - DNA, 51 bp, Artificial Sequence; identical to SEQ ID NO: 25901
  Description of Artificial Sequence: Synthetic oligonucleotide

SEQ ID NO: 25908 - DNA, 43 bp, Artificial Sequence
  Description of Artificial Sequence: Synthetic oligonucleotide
ggaagaccgatgggcccttggtggargcygadgagacrgtgac

SEQ ID NO: 25909 - DNA, 43 bp, Artificial Sequence
  Description of Artificial Sequence: Synthetic oligonucleotide
ggaagaccgatgggcccttggtggaggctgaggagacggtgac

SEQ ID NO: 25910 - DNA, 77 bp, Artificial Sequence
  Description of Artificial Sequence: Synthetic oligonucleotide
  modified_base (50)..(56): a, c, t, or g
aatgatacggcgaccaccgagatctacacgttgtaaaacgacggccagtnnnnnnngacatccagwtgacccagtct

SEQ ID NO: 25911 - DNA, 77 bp, Artificial Sequence
  Description of Artificial Sequence: Synthetic oligonucleotide
  modified_base (50)..(56): a, c, t, or g
aatgatacggcgaccaccgagatctacacgttgtaaaacgacggccagtnnnnnnngatgttgtgatgactcagtct

SEQ ID NO: 25912 - DNA, 77 bp, Artificial Sequence
  Description of Artificial Sequence: Synthetic oligonucleotide
  modified_base (50)..(56): a, c, t, or g
aatgatacggcgaccaccgagatctacacgttgtaaaacgacggccagtnnnnnnngaaattgtgwtgacrcagtct

SEQ ID NO: 25913 - DNA, 75 bp, Artificial Sequence
  Description of Artificial Sequence: Synthetic oligonucleotide
  modified_base (50)..(56): a, c, t, or g
aatgatacggcgaccaccgagatctacacgttgtaaaacgacggccagtnnnnnnngaaacgacactcacgcagt

SEQ ID NO: 25914 - DNA, 77 bp, Artificial Sequence
  Description of Artificial Sequence: Synthetic oligonucleotide
  modified_base (50)..(56): a, c, t, or g
aatgatacggcgaccaccgagatctacacgttgtaaaacgacggccagtnnnnnnngaaattgtgctgactcagtct

SEQ ID NO: 25915 - DNA, 24 bp, Artificial Sequence
  Description of Artificial Sequence: Synthetic oligonucleotide
caagcagaagacggcatacgagat

SEQ ID NO: 25916 - DNA, 75 bp, Artificial Sequence
  Description of Artificial Sequence: Synthetic oligonucleotide
  modified_base (50)..(56): a, c, t, or g
aatgatacggcgaccaccgagatctacacgttgtaaaacgacggccagtnnnnnnntggtggtggatctgctagc

SEQ ID NO: 25917 - DNA, 24 bp, Artificial Sequence
  Description of Artificial Sequence: Synthetic oligonucleotide
caagcagaagacggcatacgagat

SEQ ID NO: 25918 - DNA, 77 bp, Artificial Sequence; identical to SEQ ID NO: 25910
  Description of Artificial Sequence: Synthetic oligonucleotide
  modified_base (50)..(56): a, c, t, or g

SEQ ID NO: 25919 - DNA, 77 bp, Artificial Sequence; identical to SEQ ID NO: 25911
  Description of Artificial Sequence: Synthetic oligonucleotide
  modified_base (50)..(56): a, c, t, or g

SEQ ID NO: 25920 - DNA, 77 bp, Artificial Sequence; identical to SEQ ID NO: 25912
  Description of Artificial Sequence: Synthetic oligonucleotide
  modified_base (50)..(56): a, c, t, or g

SEQ ID NO: 25921 - DNA, 75 bp, Artificial Sequence; identical to SEQ ID NO: 25913
  Description of Artificial Sequence: Synthetic oligonucleotide
  modified_base (50)..(56): a, c, t, or g

SEQ ID NO: 25922 - DNA, 77 bp, Artificial Sequence; identical to SEQ ID NO: 25914
  Description of Artificial Sequence: Synthetic oligonucleotide
  modified_base (50)..(56): a, c, t, or g

SEQ ID NO: 25923 - DNA, 24 bp, Artificial Sequence
  Description of Artificial Sequence: Synthetic oligonucleotide
caagcagaagacggcatacgagat

SEQ ID NO: 25924 - DNA, 24 bp, Artificial Sequence
  Description of Artificial Sequence: Synthetic oligonucleotide
caagcagaagacggcatacgagat

SEQ ID NO: 25925 - DNA, 75 bp, Artificial Sequence
  Description of Artificial Sequence: Synthetic oligonucleotide
  modified_base (50)..(56): a, c, t, or g
aatgatacggcgaccaccgagatctacacgttgtaaaacgacggccagtnnnnnnncagrtgcagctggtgcart

SEQ ID NO: 25926 - DNA, 75 bp, Artificial Sequence
  Description of Artificial Sequence: Synthetic oligonucleotide
  modified_base (50)..(56): a, c, t, or g
aatgatacggcgaccaccgagatctacacgttgtaaaacgacggccagtnnnnnnnsaggtccagctggtrcagt

SEQ ID NO: 25927 - DNA, 75 bp, Artificial Sequence
  Description of Artificial Sequence: Synthetic oligonucleotide
  modified_base (50)..(56): a, c, t, or g
aatgatacggcgaccaccgagatctacacgttgtaaaacgacggccagtnnnnnnncagrtcaccttgaaggagt

SEQ ID NO: 25928 - DNA, 74 bp, Artificial Sequence
  Description of Artificial Sequence: Synthetic oligonucleotide
  modified_base (50)..(56): a, c, t, or g
aatgatacggcgaccaccgagatctacacgttgtaaaacgacggccagtnnnnnnnsaggtgcagctggtggag

SEQ ID NO: 25929 - DNA, 75 bp, Artificial Sequence
  Description of Artificial Sequence: Synthetic oligonucleotide
  modified_base (50)..(56): a, c, t, or g
aatgatacggcgaccaccgagatctacacgttgtaaaacgacggccagtnnnnnnncaggtgcagctacagcagt

SEQ ID NO: 25930 - DNA, 75 bp, Artificial Sequence
  Description of Artificial Sequence: Synthetic oligonucleotide
  modified_base (50)..(56): a, c, t, or g
aatgatacggcgaccaccgagatctacacgttgtaaaacgacggccagtnnnnnnncagstgcagctgcaggagt

SEQ ID NO: 25931 - DNA, 75 bp, Artificial Sequence
  Description of Artificial Sequence: Synthetic oligonucleotide
  modified_base (50)..(56): a, c, t, or g
aatgatacggcgaccaccgagatctacacgttgtaaaacgacggccagtnnnnnnngargtgcagctggtgcagt

SEQ ID NO: 25932 - DNA, 76 bp, Artificial Sequence
  Description of Artificial Sequence: Synthetic oligonucleotide
  modified_base (50)..(56): a, c, t, or g
aatgatacggcgaccaccgagatctacacgttgtaaaacgacggccagtnnnnnnncaggtacagctgcagcagtc

SEQ ID NO: 25933 - DNA, 24 bp, Artificial Sequence
  Description of Artificial Sequence: Synthetic oligonucleotide
caagcagaagacggcatacgagat

SEQ ID NO: 25934 - DNA, 38 bp, Artificial Sequence
  Description of Artificial Sequence: Synthetic oligonucleotide
gaccaccgagatctacacgttgtaaaacgacggccagt

SEQ ID NO: 25935 - DNA, 33 bp, Artificial Sequence
  Description of Artificial Sequence: Synthetic oligonucleotide
acactctttccctacacgacgctcttccgatct

SEQ ID NO: 25936 - DNA, 32 bp, Artificial Sequence
  Description of Artificial Sequence: Synthetic oligonucleotide
ccaccaagggcccatcsgtcggctgactgact

SEQ ID NO: 25937 - DNA, 32 bp, Artificial Sequence
  Description of Artificial Sequence: Synthetic oligonucleotide
agtcagtcagccgacsgatgggcccttggtgg

SEQ ID NO: 25938 - DNA, 37 bp, Artificial Sequence
  Description of Artificial Sequence: Synthetic oligonucleotide
cggtctcggcattcctgctgaaccgctcttccgatct

SEQ ID NO: 25939 - DNA, 38 bp, Artificial Sequence; identical to SEQ ID NO: 25934
  Description of Artificial Sequence: Synthetic oligonucleotide

SEQ ID NO: 25940 - DNA, 33 bp, Artificial Sequence; identical to SEQ ID NO: 25935
  Description of Artificial Sequence: Synthetic oligonucleotide

SEQ ID NO: 25941 - DNA, 39 bp, Artificial Sequence
  Description of Artificial Sequence: Synthetic oligonucleotide
ccccatcdgtctatccactggcccctgggctgactgact

SEQ ID NO: 25942 - DNA, 39 bp, Artificial Sequence
  Description of Artificial Sequence: Synthetic oligonucleotide
ccccatctgtctatcccttggtccctgggctgactgact

SEQ ID NO: 25943 - DNA, 39 bp, Artificial Sequence
  Description of Artificial Sequence: Synthetic oligonucleotide
agtcagtcagcccaggggccagtggatagachgatgggg

SEQ ID NO: 25944 - DNA, 39 bp, Artificial Sequence
  Description of Artificial Sequence: Synthetic oligonucleotide
agtcagtcagcccagggaccaagggatagacagatgggg

SEQ ID NO: 25945 - DNA, 37 bp, Artificial Sequence; identical to SEQ ID NO: 25938
  Description of Artificial Sequence: Synthetic oligonucleotide

SEQ ID NO: 25946 - DNA, 32 bp, Artificial Sequence; identical to SEQ ID NO: 25937
  Description of Artificial Sequence: Synthetic oligonucleotide

SEQ ID NO: 25947 - DNA, 32 bp, Artificial Sequence; identical to SEQ ID NO: 25937
  Description of Artificial Sequence: Synthetic oligonucleotide

SEQ ID NO: 25948 - DNA, 33 bp, Artificial Sequence
  Description of Artificial Sequence: Synthetic oligonucleotide
agtcagtcagcccaggggccagtggatagachg

SEQ ID NO: 25949 - DNA, 33 bp, Artificial Sequence
  Description of Artificial Sequence: Synthetic oligonucleotide
agtcagtcagcccagggaccaagggatagacag

SEQ ID NO: 25950 - DNA, 32 bp, Artificial Sequence; identical to SEQ ID NO: 25937
  Description of Artificial Sequence: Synthetic oligonucleotide

SEQ ID NO: 25951 - protein, 111 aa, Artificial Sequence
  Description of Artificial Sequence: Synthetic polypeptide
  MOD_RES (4)..(4): Ile or Val
  MOD_RES (19)..(19): Phe or Leu
  MOD_RES (20)..(20): Thr or Ile
  MOD_RES (21)..(21): Val or Phe
  MOD_RES (23)..(23): Ser or Phe
  MOD_RES (48)..(48): Ser or Asn
  MOD_RES (50)..(50): Phe or Tyr
  MOD_RES (52)..(52): Ala or Thr
  MOD_RES (91)..(91): Leu or Tyr
  MOD_RES (92)..(92): Gly or Ser or Ala
  MOD_RES (93)..(93): Pro or Ala
  MOD_RES (94)..(94): Arg or Ala
  MOD_RES (96)..(96): Gly or Tyr
  MOD_RES (97)..(97): Ile or Phe
  MOD_RES (98)..(98): Asp or Pro
GGLXQPGGSLRLSCAASGXXXSXNYMSWVRQAPGKGLEWVSVIYSGGXTXYXDSVKGRFTISRDNSKNTLYLQMNSLRAEDTAVYYCARDXXXXGXXXYWGQGTLVTVSSA

SEQ ID NO: 25952 - protein, 115 aa, Artificial Sequence
  Description of Artificial Sequence: Synthetic polypeptide
PEVKKPGTSVKVSCKASGFTFTSSAVQWVRQARGQRLEWIGWIWGSGNTNYAQKFQERVTITRDMSTSTAYMELSSLRSEDTAVYYCAAPYCSSTSCHDAFDIWGQGTMVTVSSA

SEQ ID NO: 25953 - protein, 116 aa, Artificial Sequence
  Description of Artificial Sequence: Synthetic polypeptide
GGVVQPGRSLRLSCAASGFTFSSYGMHWVRQAPGKGLEWVAVISYDGSNKYYADSVKGRFTISRDNSKNTLYLQMNSLRAEDTAVYYCAKHGYSYGYWLGYFDYWGQGTLVTVSSA

SEQ ID NO: 25954 - protein, 111 aa, Artificial Sequence
  Description of Artificial Sequence: Synthetic polypeptide
  MOD_RES (6)..(6): Pro or Thr
  MOD_RES (17)..(17): Ser or Thr
  MOD_RES (19)..(19): Phe or Val
  MOD_RES (21)..(21): Val or Phe
  MOD_RES (27)..(27): Ser or Asn
  MOD_RES (41)..(41): Ser or Leu
  MOD_RES (42)..(42): Val or Leu
  MOD_RES (50)..(50): Tyr or Phe
  MOD_RES (55)..(55): Val or Leu
  MOD_RES (64)..(64): Asp or His
  MOD_RES (90)..(90): Asp or Glu
  MOD_RES (91)..(91): Cys or Thr or Leu
  MOD_RES (92)..(92): Leu or Met
  MOD_RES (93)..(93): Gly or Val
  MOD_RES (94)..(94): Tyr or Ile
  MOD_RES (95)..(95): Gly or Pro
  MOD_RES (105)..(105): Thr or Met
GGLYQXGGSLRLSCAAXGXTXSSNYMXWVRQAPGKGLEWVXXIYSGGSTXYADSXKGRFTISRXNSKNTLYLQMNSLRAEDTAVYYCARXXXXXXSMDVWGQGTXVTVSSA

SEQ ID NO: 25955 - protein, 110 aa, Artificial Sequence
  Description of Artificial Sequence: Synthetic polypeptide
  MOD_RES (21)..(21): Val or Phe
  MOD_RES (23)..(23): Thr or Ser
  MOD_RES (49)..(49): Thr or Ala
  MOD_RES (56)..(56): Lys or Glu
  MOD_RES (61)..(61): Ile or Thr
  MOD_RES (82)..(82): Thr or Ala
  MOD_RES (86)..(86): Phe or Tyr
  MOD_RES (91)..(91): His or Asn
  MOD_RES (98)..(98): Tyr or His
  MOD_RES (101)..(101): Gln or Pro
  MOD_RES (104)..(104): Leu or Arg
  MOD_RES (110)..(110): Ser or Ala
GGLIQPGGSLRLSCAASGFTXSXNYMSWVRQAPGKGLEWVSVIYSGGSXFYADSVXGRFTXSRDNSKNTLYLQMNSLRAEDXAVYXCARGXWEYYFDXWGXGTXVTVSSX

SEQ ID NO: 25956 - protein, 116 aa, Artificial Sequence
  Description of Artificial Sequence: Synthetic polypeptide
GGLVQPGGSLRLSCAASGFTFSSYAMSWVRQAPGKGLEWVSAISGSGGSTYYADSVKGRFTISRDNSKNTLYLQMNSLRAEDTAVYYCAKEGMVLRYFDWLWDYWGQGTLVTVSSA

SEQ ID NO: 25957 - protein, 113 aa, Artificial Sequence
  Description of Artificial Sequence: Synthetic polypeptide
  MOD_RES (23)..(23): Ser or Asn
  MOD_RES (41)..(41): Ala or Thr
  MOD_RES (42)..(42): Val or Leu
  MOD_RES (44)..(44): Trp or Ser
  MOD_RES (48)..(48): Ser or Asn or Thr
  MOD_RES (69)..(69): Asn or Asp
  MOD_RES (91)..(91): Asp or Glu
  MOD_RES (92)..(92): Arg or Leu or Asn
  MOD_RES (93)..(93): Ser or Val or Leu
  MOD_RES (94)..(94): Ser or Asn or Leu
  MOD_RES (96)..(96): Pro or Trp or Thr
  MOD_RES (98)..(98): Gly or His or Tyr
GGVVQPGRSLRLSCAASGFTFSXYGMHWVRQAPGKGLEWVXXIXYDGXNKYYADSVKGRFTISRDNSKXTLYLQMNSLRAEDTAVYYCARXXXXGXSXFDYWGQGTLVTVSSA

SEQ ID NO: 25958 - protein, 112 aa, Artificial Sequence
  Description of Artificial Sequence: Synthetic polypeptide
  MOD_RES (5)..(5): Gln or Arg
  MOD_RES (8)..(8): Gly or Arg
  MOD_RES (35)..(35): Lys or Arg
  MOD_RES (42)..(42): Ala or Thr
  MOD_RES (90)..(90): Lys or Glu or Arg
  MOD_RES (91)..(91): Glu or Thr
  MOD_RES (92)..(92): Gln or Phe or Thr
  MOD_RES (93)..(93): Leu or Trp or Ile
  MOD_RES (94)..(94): Leu or Val or Trp
  MOD_RES (95)..(95): Gly or Leu
  MOD_RES (96)..(96): Val or Lys
  MOD_RES (97)..(97): Val or Pro or Leu
  MOD_RES (98)..(98): Phe or Leu or Asn
  MOD_RES (99)..(99): Asp or Asn
  MOD_RES (102)..(102): Gly or Val
GGLVXPGXSLRLSCAASGFTFSSYAMSWVRQAPGXGLEWVSXISGSGGSTYYADSVKGRFTISRDNSKNTLYLQMNSLRAEDTAVYYCAXXXXXXXXXXYWXQGTLVTVSSA

SEQ ID NO: 25959 - protein, 115 aa, Artificial Sequence
  Description of Artificial Sequence: Synthetic polypeptide
  MOD_RES (2)..(2): Gly or Val
  MOD_RES (3)..(3): Val or Leu
  MOD_RES (20)..(20): Thr or Asn
  MOD_RES (24)..(24): Tyr or His
  MOD_RES (27)..(27): Ser or Asn
  MOD_RES (32)..(32): Ala or Val
  MOD_RES (48)..(48): Gly or Asp
  MOD_RES (83)..(83): Thr or Ser
  MOD_RES (91)..(91): Asp or Asn
  MOD_RES (92)..(92): Arg or Gly
  MOD_RES (95)..(95): Ser or Thr
  MOD_RES (96)..(96): Gly or Ser or Trp or Phe
  MOD_RES (97)..(97): Trp or Phe or Tyr
  MOD_RES (98)..(98): Arg or Phe or Tyr or Asn
  MOD_RES (100)..(100): Trp or Ala
  MOD_RES (103)..(103): Pro or Ile
  MOD_RES (108)..(108): Thr or Ala
  MOD_RES (109)..(109): Leu or Met
GXXVRPGGSLRLSCAASGFXFDDXGMXWVRQXPGKGLEWVSGINWNGXSTGYADSVKGRFTISRDNAKNSLYLQMNSLRAEDXALYHCARXXGSXXXXDXFDXWGQGXXVTVSSA

SEQ ID NO: 25960 - protein, 113 aa, Artificial Sequence
  Description of Artificial Sequence: Synthetic polypeptide
  MOD_RES (24)..(24): Tyr or Asp
  MOD_RES (25)..(25): Tyr or Phe or Leu
  MOD_RES (27)..(27): Ser or Cys
  MOD_RES (29)..(29): Ile or Val
  MOD_RES (41)..(41): Ser or Ala
  MOD_RES (48)..(48): Ser or Tyr
  MOD_RES (62)..(62): Thr or Ile
  MOD_RES (76)..(76): Ser or Asn
  MOD_RES (95)..(95): Arg or Ser
  MOD_RES (98)..(98): Val or Asn
  MOD_RES (101)..(101): Thr or Asn or Ser
GGLVKPGGSLRLSCAASGFTFSDXXMXWXRQAPGKGLEWVXYISGSGXTIYYADSVKGRFTXSRDNAKNSLYLQMXSLRAEDTAVYYCARDEGYXGYXLDXWGQGTLVTVSSA

SEQ ID NO: 25961 - protein, 106 aa, Artificial Sequence
  Description of Artificial Sequence: Synthetic polypeptide
  MOD_RES (16)..(16): Thr or Ala
  MOD_RES (19)..(19): Phe or Leu
  MOD_RES (23)..(23): Ser or Thr
  MOD_RES (26)..(26): Met or Ile
  MOD_RES (42)..(42): Asn or His
  MOD_RES (44)..(44): Asn or Asp
  MOD_RES (48)..(48): Ser or Thr
  MOD_RES (49)..(49): Val or Ala
  MOD_RES (51)..(51): Tyr or His
  MOD_RES (97)..(97): Gln or Arg
GGLVQPGGSLRLSCAXSGXTFSXHWXDWVRQAPGKGLEWVAXIXQDGXXIXYVDSVKGRFTISRDNTKNSLYLQMNSLRAEDTAVYYCTRALDYWGXGTLVTVSSA

SEQ ID NO: 25962 - protein, 119 aa, Artificial Sequence
  Description of Artificial Sequence: Synthetic polypeptide
  MOD_RES (2)..(2): Glu or Gly
  MOD_RES (10)..(10): Val or Met
  MOD_RES (11)..(11): Lys or Arg
  MOD_RES (26)..(26): Phe or Leu
  MOD_RES (39)..(39): Trp or Gly
  MOD_RES (40)..(40): Met or Val
  MOD_RES (80)..(80): Ser or Tyr
  MOD_RES (100)..(100): Pro or Thr
  MOD_RES (106)..(106): Asp or Gly
  MOD_RES (115)..(115): Thr or Ala
AXVKRPGASXXVSCKAPGDTFTNFGXSWVRQAPGHGLEXXGWINAYNDNTNYTQKFQDRVTMTTDTSTSTAYMELRSLRXDDTAVYFCARVSARRILTAXRYPLIXSWGQGTLVXVSSA

SEQ ID NO: 25963 - protein, 115 aa, Artificial Sequence
  Description of Artificial Sequence: Synthetic polypeptide
  MOD_RES (12)..(12): Ile or Thr
  MOD_RES (15)..(15): Lys or Arg
  MOD_RES (21)..(21): Phe or Leu
  MOD_RES (26)..(26): Ile or Val
  MOD_RES (35)..(35): Lys or Arg
  MOD_RES (60)..(60): Val or Ala
  MOD_RES (77)..(77): Ser or Gly
AEVKKPGESLRXSCXGSGYSXTSFWXSWVRQMPGXGLEWMGKIDPSDSDTRYSPSLEGHXTMSVDTSTNTTYLQWRXLKASDTAIYYCARHMARDSIGYYHDFWGQGILVTVSSA

SEQ ID NO: 25964 - protein, 115 aa, Artificial Sequence
  Description of Artificial Sequence: Synthetic polypeptide
  MOD_RES (9)..(9): Ser or Leu
  MOD_RES (14)..(14): Cys or Tyr
  MOD_RES (20)..(20): Thr or Ala
  MOD_RES (38)..(38): Glu or Gly
  MOD_RES (55)..(55): Asn or Asp
  MOD_RES (65)..(65): Asp or Gly
GEVKKPGAXVKVSXKTSGYXFISYDITWVRQAPGQGLXWMGSISAYYRNASYAQXVQDRVTMTTXTSTSTAYMELKSLKSDDTAVYYCARVRYPISADNRWDHWGQGTLVTVSSA

SEQ ID NO: 25965 - protein, 109 aa, Artificial Sequence
  Description of Artificial Sequence: Synthetic polypeptide
  MOD_RES (17)..(17): Tyr or Cys
  MOD_RES (31)..(31): Gln or His
  MOD_RES (33)..(33): Pro or Ser
  MOD_RES (44)..(44): Asn or Ser
  MOD_RES (60)..(60): Thr or Ile
  MOD_RES (103)..(103): Leu or Pro
AEVEKPGASVKVSCKAXGYTFTDYYIHWVRXAXGQGLEWLGRIXPTTGTIYAQKFQDRVXLTSDTSINTAYMELSSLTFDDTTAVYYCGRGVRSFNPWGQGTXVTVSSA

SEQ ID NO: 25966 - protein, 112 aa, Artificial Sequence
  Description of Artificial Sequence: Synthetic polypeptide
GGLVQPGGSLRLSCAASGFNFDMSWMGWVRQAPGKGLEWVANIKPDGSERHYADSVKGRFTISRDNPKKSLFLQLDSLTGEDTALYYCARDGGRYGDFDYWGQGTLVTVSSA

SEQ ID NO: 25967 - protein, 116 aa, Artificial Sequence
  Description of Artificial Sequence: Synthetic polypeptide
  MOD_RES (23)..(23): Ile or Thr
  MOD_RES (29)..(29): Asn or Ser
  MOD_RES (31)..(31): Ile or Thr
  MOD_RES (53)..(53): Asn or Thr
  MOD_RES (57)..(57): Val or Leu
  MOD_RES (60)..(60): Val or Met
  MOD_RES (75)..(75): Phe or Leu
  MOD_RES (80)..(80): Asn or Arg
  MOD_RES (84)..(84): Pro or Thr
  MOD_RES (87)..(87): Thr or Pro
  MOD_RES (88)..(88): Ala or Thr
  MOD_RES (110)..(110): Met or Thr
PGLVKPSQTLSLTCAISGDSVSXNSGAWXWXRQSPSRGLEWLGRTYYNSKWYXDYAXSVXKSRITINPDTSKNQXSLQLXSVTXEDXXVYYCARLDWNYRAFDIWGQGTXVTVSSA

SEQ ID NO: 25968 - protein, 109 aa, Artificial Sequence
  Description of Artificial Sequence: Synthetic polypeptide
  MOD_RES (3)..(3): Leu or Val
  MOD_RES (5)..(5): Gln or Arg
  MOD_RES (12)..(12): Leu or Pro
  MOD_RES (13)..(13): Ala or Ser
  MOD_RES (17)..(17): Ser or Pro
  MOD_RES (22)..(22): Ser or Arg
  MOD_RES (24)..(24): His or Tyr or Asn
  MOD_RES (25)..(25): Tyr or Met
  MOD_RES (44)..(44): Met or Lys
  MOD_RES (45)..(45): Gln or Arg
  MOD_RES (49)..(49): Gln or Glu
  MOD_RES (51)..(51): Ser or Phe or Val
  MOD_RES (54)..(54): Asp or Asn
  MOD_RES (56)..(56): Val or Met
  MOD_RES (59)..(59): Arg or Met
  MOD_RES (60)..(60): Phe or Leu
  MOD_RES (62)..(62): Ile or Thr
  MOD_RES (68)..(68): Asp or Lys
  MOD_RES (71)..(71): Leu or Val
  MOD_RES (72)..(72): Tyr or Phe
  MOD_RES (74)..(74): Gln or Glu
  MOD_RES (77)..(77): Ser or Asn
  MOD_RES (97)..(97): Ser or Tyr
  MOD_RES (102)..(102): Thr or Ala
  MOD_RES (105)..(105): Thr or Ala
  MOD_RES (106)..(106): Val or Ala
  MOD_RES (108)..(108): Ser or Pro
GGXVXPGGSLRXXCAAXGFTFXSXXMGWVRQAPGKGLEWVANIXXDGSXKXYVXSXKGXXTXSRDNAXNSXXLXMNXLRAEDTAVYYCGSRRPYFDXWGQGXLVXXSXA

SEQ ID NO: 25969 - protein, 109 aa, Artificial Sequence
  Description of Artificial Sequence: Synthetic polypeptide
  MOD_RES (7)..(7): Gly or Arg
  MOD_RES (9)..(9): Ser or Pro
  MOD_RES (14)..(14): Cys or Arg
  MOD_RES (15)..(15): Val or Ala
  MOD_RES (16)..(16): Gly or Ala
  MOD_RES (22)..(22): Ser or Asn
  MOD_RES (26)..(26): Met or Val
  MOD_RES (43)..(43): Ile or Thr
  MOD_RES (45)..(45): Pro or Gln
  MOD_RES (52)..(52): Tyr or Met
  MOD_RES (63)..(63): Ser or Pro
  MOD_RES (77)..(77): Leu or Met
  MOD_RES (84)..(84): Val or Met
  MOD_RES (93)..(93): Arg or Gln
  MOD_RES (102)..(102): Thr or Ala
GGLVQPXGXLRLSXXXSGFTFXNYWXSWVRQAPGKGLEWVANXKXDEGEKYXVDSVKGRFTIXRDNAKNSLYLQMNXRAEDTAXYFCARRWEXYFDYWGQGXLVTVSSA

SEQ ID NO: 25970 - protein, 112 aa, Artificial Sequence
  Description of Artificial Sequence: Synthetic polypeptide
  MOD_RES (5)..(5): Gln or Arg
  MOD_RES (6)..(6): Pro or Asn
  MOD_RES (14)..(14): Cys or Arg
  MOD_RES (19)..(19): Phe or Leu
  MOD_RES (20)..(20): Thr or Ala
  MOD_RES (28)..(28): Trp or Arg
  MOD_RES (32)..(32): Thr or Ser
  MOD_RES (42)..(42): Arg or Asn
  MOD_RES (47)..(47): Pro or Leu or Ser
  MOD_RES (53)..(53): Glu or Gly
  MOD_RES (54)..(54): Tyr or Cys
  MOD_RES (60)..(60): Gly or Asp
  MOD_RES (62)..(62): Phe or Ser
  MOD_RES (68)..(68): Asp or Gly
  MOD_RES (77)..(77): Met or Thr
  MOD_RES (78)..(78): Asn or Asp
  MOD_RES (80)..(80): Leu or Pro or Met
  MOD_RES (83)..(83): Asp or Gly
  MOD_RES (84)..(84): Asp or Gly
  MOD_RES (94)..(94): Arg or Asn
  MOD_RES (97)..(97): Phe or Leu
  MOD_RES (107)..(107): Val or Ala
  MOD_RES (111)..(111): Ser or Pro
  MOD_RES (112)..(112): Ala or Thr
GGLVXXGGSLRLSXAASGXXFSDYFMDXVRQXPDKGLEWIGXIRNKXNRYTTXXAASVKXRXSVSRDXSKNSLYLQXXSXKTXXTAVYYCCRDXEGXGDVWGQGTTXTVSXX

SEQ ID NO: 25971 - protein, 116 aa, Artificial Sequence
  Description of Artificial Sequence: Synthetic polypeptide
  MOD_RES (90)..(90): Any amino acid
  MOD_RES (94)..(94): Tyr or Gly
  MOD_RES (96)..(96): Ser or Thr
  MOD_RES (100)..(100): Any amino acid
  MOD_RES (101)..(101): Any amino acid
  MOD_RES (104)..(104): Tyr or Val
  MOD_RES (110)..(110): Leu or Thr
GGVVQPGRSLRLSCAASGFTFSSYGMHWVRQAPGKGLEWVAVIWYDGSNKYYADSVKGRFTISRDNSKNTLYLQMNSLRAEDTAVYYCRXGGYXGXGSLXXFDXWGQGTXVTVSSA

SEQ ID NO: 25972 - protein, 110 aa, Artificial Sequence
  Description of Artificial Sequence: Synthetic polypeptide
PGLVKPSETLSLTCTFSGGSISYYYWSWIRQPPGKGLEWIGYIYYSGSTNYNPSLKSRVTMSVDTSKNQFSLKLSSVTAADTAVYYCTRETLERGFDYWGQGTLVTVSSA

SEQ ID NO: 25973 - protein, 113 aa, Artificial Sequence
  Description of Artificial Sequence: Synthetic polypeptide
  MOD_RES (23)..(23): Ser or Asn
  MOD_RES (75)..(75): Ser or Thr
  MOD_RES (90)..(90): Lys or Ala
  MOD_RES (91)..(91): Val or Arg
  MOD_RES (92)..(92): Ala or Asn
  MOD_RES (93)..(93): Any amino acid
  MOD_RES (94)..(94): Any amino acid
  MOD_RES (95)..(95): Gly or Arg
  MOD_RES (96)..(96): Tyr or Thr or Gly
  MOD_RES (97)..(97): Trp or Arg
  MOD_RES (99)..(99): Phe or Leu
  MOD_RES (101)..(101): Leu or Tyr or Pro
  MOD_RES (104)..(104): Arg or Gln
PGLVKPSETLSLTCTVSGGSISXYYWSWIRQPPGKGLEWIGYIYYSGSTNYNPSLKSRVTISVDTSKNQFSLKLXSVTAADTAVYYCARXXXXXXXXYXDXWGXGTLVTVSSA

SEQ ID NO: 25974 - protein, 115 aa, Artificial Sequence
  Description of Artificial Sequence: Synthetic polypeptide
AEVKKPGASVKVSCKASGYTFTSYYMHWVRQAPGQGLEWMGIINPSGGSTSYAQKFQGRVTMTRDTSTSTVYMELSSLRSEDTAVYYCARAPLLLWFGEFIDYWGQGTLVTVSSA

SEQ ID NO: 25975 - protein, 121 aa, Artificial Sequence
  Description of Artificial Sequence: Synthetic polypeptide
  MOD_RES (20)..(20): Thr or Pro
  MOD_RES (26)..(26): Met or Thr
  MOD_RES (43)..(43): Ile or Lys
  MOD_RES (44)..(44): Trp or Phe or Ser
  MOD_RES (45)..(45): Tyr or Phe
  MOD_RES (48)..(48): Ser or Asn
  MOD_RES (51)..(51): Tyr or Phe
  MOD_RES (53)..(53): Ala or Thr
  MOD_RES (62)..(62): Ile or Thr
  MOD_RES (69)..(69): Asn or Asp
  MOD_RES (91)..(91): Asp or Glu
  MOD_RES (94)..(94): Arg or Tyr
  MOD_RES (95)..(95): Tyr or Asn
  MOD_RES (96)..(96): Asp or Ser
  MOD_RES (102)..(102): Gly or Trp
  MOD_RES (103)..(103): Gly or Asn
  MOD_RES (104)..(104): Any amino acid
  MOD_RES (105)..(105): Any amino acid
  MOD_RES (106)..(106): Ala or Tyr
  MOD_RES (107)..(107): Phe or Pro or Leu
GGVVQPGRSLRLSCAASGFXFSSYGXHWVRQAPGKGLEWVAVXXXDGXNKXYXDSVKGRFTXSRDNSKXTLYLQMNSLRAEDTAVYYCARXAKXXXILTGYXXXXXXDYWGQGTLVTVSSA
